United States Patent 12,774,281 (HETEROCYCLIC AMIDES AND THEIR USE FOR MODULATING SPLICING) - sequence listing, part 2

SEQ ID NO: 3960 - RNA, 10 nt, Unknown
  source: /note="Description of Unknown: Exemplary gene or splice site sequence"
gagguuugcc

SEQ ID NO: 3961 - RNA, 10 nt, Unknown
  source: /note="Description of Unknown: Exemplary gene or splice site sequence"
gggguggggg

SEQ ID NO: 3962 - RNA, 10 nt, Unknown
  source: /note="Description of Unknown: Exemplary gene or splice site sequence"
gcgguuagug

SEQ ID NO: 3963 - RNA, 10 nt, Unknown
  source: /note="Description of Unknown: Exemplary gene or splice site sequence"
augguaguug

SEQ ID NO: 3964 - RNA, 10 nt, Unknown
  source: /note="Description of Unknown: Exemplary gene or splice site sequence"
cauguaagac

SEQ ID NO: 3965 - RNA, 10 nt, Unknown
  source: /note="Description of Unknown: Exemplary gene or splice site sequence"
uucguaagga

SEQ ID NO: 3966 - RNA, 10 nt, Unknown
  source: /note="Description of Unknown: Exemplary gene or splice site sequence"
gaaguaugac

SEQ ID NO: 3967 - RNA, 10 nt, Unknown
  source: /note="Description of Unknown: Exemplary gene or splice site sequence"
cauguagggc

SEQ ID NO: 3968 - RNA, 10 nt, Unknown
  source: /note="Description of Unknown: Exemplary gene or splice site sequence"
accgucagga

SEQ ID NO: 3969 - RNA, 10 nt, Unknown
  source: /note="Description of Unknown: Exemplary gene or splice site sequence"
cguguucgau

SEQ ID NO: 3970 - RNA, 10 nt, Unknown
  source: /note="Description of Unknown: Exemplary gene or splice site sequence"
gaggcaggac

SEQ ID NO: 3971 - RNA, 10 nt, Unknown
  source: /note="Description of Unknown: Exemplary gene or splice site sequence"
ucgguauacu

SEQ ID NO: 3972 - RNA, 10 nt, Unknown
  source: /note="Description of Unknown: Exemplary gene or splice site sequence"
uagguugugc

SEQ ID NO: 3973 - RNA, 10 nt, Unknown
  source: /note="Description of Unknown: Exemplary gene or splice site sequence"
ccggugaguc

SEQ ID NO: 3974 - RNA, 10 nt, Unknown
  source: /note="Description of Unknown: Exemplary gene or splice site sequence"
guggugaggg

SEQ ID NO: 3975 - RNA, 10 nt, Unknown
  source: /note="Description of Unknown: Exemplary gene or splice site sequence"
ugggucagua

SEQ ID NO: 3976 - RNA, 10 nt, Unknown
  source: /note="Description of Unknown: Exemplary gene or splice site sequence"
ccuguuggua

SEQ ID NO: 3977 - RNA, 10 nt, Unknown
  source: /note="Description of Unknown: Exemplary gene or splice site sequence"
gagguaucca

SEQ ID NO: 3978 - RNA, 10 nt, Unknown
  source: /note="Description of Unknown: Exemplary gene or splice site sequence"
aaaguuaaag

SEQ ID NO: 3979 - RNA, 10 nt, Unknown
  source: /note="Description of Unknown: Exemplary gene or splice site sequence"
gaggugcuau

SEQ ID NO: 3980 - RNA, 10 nt, Unknown
  source: /note="Description of Unknown: Exemplary gene or splice site sequence"
cuugugugca

SEQ ID NO: 3981 - RNA, 10 nt, Unknown
  source: /note="Description of Unknown: Exemplary gene or splice site sequence"
ugagcugggg

SEQ ID NO: 3982 - RNA, 10 nt, Unknown
  source: /note="Description of Unknown: Exemplary gene or splice site sequence"
aagguauagu

SEQ ID NO: 3983 - RNA, 10 nt, Unknown
  source: /note="Description of Unknown: Exemplary gene or splice site sequence"
ggggugaggu

SEQ ID NO: 3984 - RNA, 10 nt, Unknown
  source: /note="Description of Unknown: Exemplary gene or splice site sequence"
gaggcaagca

SEQ ID NO: 3985 - RNA, 10 nt, Unknown
  source: /note="Description of Unknown: Exemplary gene or splice site sequence"
ggaguaacgu

SEQ ID NO: 3986 - RNA, 10 nt, Unknown
  source: /note="Description of Unknown: Exemplary gene or splice site sequence"
agaguaagua

SEQ ID NO: 3987 - RNA, 10 nt, Unknown
  source: /note="Description of Unknown: Exemplary gene or splice site sequence"
gaggcaacca

SEQ ID NO: 3988 - RNA, 10 nt, Unknown
  source: /note="Description of Unknown: Exemplary gene or splice site sequence"
aggguaaaug

SEQ ID NO: 3989 - RNA, 10 nt, Unknown
  source: /note="Description of Unknown: Exemplary gene or splice site sequence"
gcugugcgug

SEQ ID NO: 3990 - RNA, 10 nt, Unknown
  source: /note="Description of Unknown: Exemplary gene or splice site sequence"
gagguucgcc

SEQ ID NO: 3991 - RNA, 10 nt, Unknown
  source: /note="Description of Unknown: Exemplary gene or splice site sequence"
aaggcuugca

SEQ ID NO: 3992 - RNA, 10 nt, Unknown
  source: /note="Description of Unknown: Exemplary gene or splice site sequence"
auaguaaguc

SEQ ID NO: 3993 - RNA, 10 nt, Unknown
  source: /note="Description of Unknown: Exemplary gene or splice site sequence"
gcagcaggua

SEQ ID NO: 3994 - RNA, 10 nt, Unknown
  source: /note="Description of Unknown: Exemplary gene or splice site sequence"
agcguaagcc

SEQ ID NO: 3995 - RNA, 10 nt, Unknown
  source: /note="Description of Unknown: Exemplary gene or splice site sequence"
cugguucgaa

SEQ ID NO: 3996 - RNA, 10 nt, Unknown
  source: /note="Description of Unknown: Exemplary gene or splice site sequence"
cuggucauug

SEQ ID NO: 3997 - RNA, 10 nt, Unknown
  source: /note="Description of Unknown: Exemplary gene or splice site sequence"
gagguguagu

SEQ ID NO: 3998 - RNA, 10 nt, Unknown
  source: /note="Description of Unknown: Exemplary gene or splice site sequence"
gagguguccu

SEQ ID NO: 3999 - RNA, 10 nt, Unknown
  source: /note="Description of Unknown: Exemplary gene or splice site sequence"
agugcccuga

SEQ ID NO: 4000 - RNA, 10 nt, Unknown
  source: /note="Description of Unknown: Exemplary gene or splice site sequence"
ugugugugua

SEQ ID NO: 4001 - RNA, 10 nt, Unknown
  source: /note="Description of Unknown: Exemplary gene or splice site sequence"
cugguacagu

SEQ ID NO: 4002 - RNA, 10 nt, Unknown
  source: /note="Description of Unknown: Exemplary gene or splice site sequence"
uugguacgua

SEQ ID NO: 4003 - RNA, 10 nt, Unknown
  source: /note="Description of Unknown: Exemplary gene or splice site sequence"
ucuguacgua

SEQ ID NO: 4004 - RNA, 10 nt, Unknown
  source: /note="Description of Unknown: Exemplary gene or splice site sequence"
uaaguaauuc

SEQ ID NO: 4005 - RNA, 10 nt, Unknown
  source: /note="Description of Unknown: Exemplary gene or splice site sequence"
cacguaugug

SEQ ID NO: 4006 - RNA, 10 nt, Unknown
  source: /note="Description of Unknown: Exemplary gene or splice site sequence"
ucggugagug

SEQ ID NO: 4007 - RNA, 10 nt, Unknown
  source: /note="Description of Unknown: Exemplary gene or splice site sequence"
aagguucaga

SEQ ID NO: 4008 - RNA, 10 nt, Unknown
  source: /note="Description of Unknown: Exemplary gene or splice site sequence"
aggguacuuc

SEQ ID NO: 4009 - RNA, 10 nt, Unknown
  source: /note="Description of Unknown: Exemplary gene or splice site sequence"
gcggcagguu

SEQ ID NO: 4010 - RNA, 10 nt, Unknown
  source: /note="Description of Unknown: Exemplary gene or splice site sequence"
gaggcccgug

SEQ ID NO: 4011 - RNA, 10 nt, Unknown
  source: /note="Description of Unknown: Exemplary gene or splice site sequence"
cagguauaaa

SEQ ID NO: 4012 - RNA, 10 nt, Unknown
  source: /note="Description of Unknown: Exemplary gene or splice site sequence"
auggucaagu

SEQ ID NO: 4013 - RNA, 10 nt, Unknown
  source: /note="Description of Unknown: Exemplary gene or splice site sequence"
gugguuuguu

SEQ ID NO: 4014 - RNA, 10 nt, Unknown
  source: /note="Description of Unknown: Exemplary gene or splice site sequence"
agagugagga

SEQ ID NO: 4015 - RNA, 10 nt, Unknown
  source: /note="Description of Unknown: Exemplary gene or splice site sequence"
uaggcgugag

SEQ ID NO: 4016 - RNA, 10 nt, Unknown
  source: /note="Description of Unknown: Exemplary gene or splice site sequence"
aagguacucc

SEQ ID NO: 4017 - RNA, 10 nt, Unknown
  source: /note="Description of Unknown: Exemplary gene or splice site sequence"
gagguaugau

SEQ ID NO: 4018 - RNA, 10 nt, Unknown
  source: /note="Description of Unknown: Exemplary gene or splice site sequence"
ggggucggua

SEQ ID NO: 4019 - RNA, 10 nt, Unknown
  source: /note="Description of Unknown: Exemplary gene or splice site sequence"
acgguaugca

SEQ ID NO: 4020 - RNA, 10 nt, Unknown
  source: /note="Description of Unknown: Exemplary gene or splice site sequence"
uaaguaccug

SEQ ID NO: 4021 - RNA, 10 nt, Unknown
  source: /note="Description of Unknown: Exemplary gene or splice site sequence"
agggugggcu

SEQ ID NO: 4022 - RNA, 10 nt, Unknown
  source: /note="Description of Unknown: Exemplary gene or splice site sequence"
cuggucuguu

SEQ ID NO: 4023 - RNA, 10 nt, Unknown
  source: /note="Description of Unknown: Exemplary gene or splice site sequence"
uaggucagag

SEQ ID NO: 4024 - RNA, 10 nt, Unknown
  source: /note="Description of Unknown: Exemplary gene or splice site sequence"
cuggucagug

SEQ ID NO: 4025 - RNA, 10 nt, Unknown
  source: /note="Description of Unknown: Exemplary gene or splice site sequence"
aaggugggac

SEQ ID NO: 4026 - RNA, 10 nt, Unknown
  source: /note="Description of Unknown: Exemplary gene or splice site sequence"
gugguaguag

SEQ ID NO: 4027 - RNA, 10 nt, Unknown
  source: /note="Description of Unknown: Exemplary gene or splice site sequence"
cuaguuuagg

SEQ ID NO: 4028 - RNA, 10 nt, Unknown
  source: /note="Description of Unknown: Exemplary gene or splice site sequence"
cccgccccau

SEQ ID NO: 4029 - RNA, 10 nt, Unknown
  source: /note="Description of Unknown: Exemplary gene or splice site sequence"
gcuguacugc

SEQ ID NO: 4030 - RNA, 10 nt, Unknown
  source: /note="Description of Unknown: Exemplary gene or splice site sequence"
uagguuggug

SEQ ID NO: 4031 - RNA, 10 nt, Unknown
  source: /note="Description of Unknown: Exemplary gene or splice site sequence"
aagguccaac

SEQ ID NO: 4032 - RNA, 10 nt, Unknown
  source: /note="Description of Unknown: Exemplary gene or splice site sequence"
uuggcaggug

SEQ ID NO: 4033 - RNA, 10 nt, Unknown
  source: /note="Description of Unknown: Exemplary gene or splice site sequence"
uagguuauug

SEQ ID NO: 4034 - RNA, 10 nt, Unknown
  source: /note="Description of Unknown: Exemplary gene or splice site sequence"
gcgguggguc

SEQ ID NO: 4035 - RNA, 10 nt, Unknown
  source: /note="Description of Unknown: Exemplary gene or splice site sequence"
uguguaagau

SEQ ID NO: 4036 - RNA, 10 nt, Unknown
  source: /note="Description of Unknown: Exemplary gene or splice site sequence"
gcagccccgg

SEQ ID NO: 4037 - RNA, 10 nt, Unknown
  source: /note="Description of Unknown: Exemplary gene or splice site sequence"
caggugcuaa

SEQ ID NO: 4038 - RNA, 10 nt, Unknown
  source: /note="Description of Unknown: Exemplary gene or splice site sequence"
cagguacauc

SEQ ID NO: 4039 - RNA, 10 nt, Unknown
  source: /note="Description of Unknown: Exemplary gene or splice site sequence"
uaaguaauua

SEQ ID NO: 4040 - RNA, 10 nt, Unknown
  source: /note="Description of Unknown: Exemplary gene or splice site sequence"
uaggugguuu

SEQ ID NO: 4041 - RNA, 10 nt, Unknown
  source: /note="Description of Unknown: Exemplary gene or splice site sequence"
uguguaagcu

SEQ ID NO: 4042 - RNA, 10 nt, Unknown
  source: /note="Description of Unknown: Exemplary gene or splice site sequence"
gauguaauau

SEQ ID NO: 4043 - RNA, 10 nt, Unknown
  source: /note="Description of Unknown: Exemplary gene or splice site sequence"
gggguaauua

SEQ ID NO: 4044 - RNA, 10 nt, Unknown
  source: /note="Description of Unknown: Exemplary gene or splice site sequence"
uagguacuac

SEQ ID NO: 4045 - RNA, 10 nt, Unknown
  source: /note="Description of Unknown: Exemplary gene or splice site sequence"
ucggugggug

SEQ ID NO: 4046 - RNA, 10 nt, Unknown
  source: /note="Description of Unknown: Exemplary gene or splice site sequence"
uaagugagcc

SEQ ID NO: 4047 - RNA, 10 nt, Unknown
  source: /note="Description of Unknown: Exemplary gene or splice site sequence"
uaggugcgac

SEQ ID NO: 4048 - RNA, 10 nt, Unknown
  source: /note="Description of Unknown: Exemplary gene or splice site sequence"
gagguauggc

SEQ ID NO: 4049 - RNA, 10 nt, Unknown
  source: /note="Description of Unknown: Exemplary gene or splice site sequence"
uugguaacgu

SEQ ID NO: 4050 - RNA, 10 nt, Unknown
  source: /note="Description of Unknown: Exemplary gene or splice site sequence"
gcuguaaaaa

SEQ ID NO: 4051 - RNA, 10 nt, Unknown
  source: /note="Description of Unknown: Exemplary gene or splice site sequence"
uugguuagua

SEQ ID NO: 4052 - RNA, 10 nt, Unknown
  source: /note="Description of Unknown: Exemplary gene or splice site sequence"
auaguaaggg

SEQ ID NO: 4053 - RNA, 10 nt, Unknown
  source: /note="Description of Unknown: Exemplary gene or splice site sequence"
uugguacuag

SEQ ID NO: 4054 - RNA, 10 nt, Unknown
  source: /note="Description of Unknown: Exemplary gene or splice site sequence"
cgggcagccg

SEQ ID NO: 4055 - RNA, 10 nt, Unknown
  source: /note="Description of Unknown: Exemplary gene or splice site sequence"
caggucuggg

SEQ ID NO: 4056 - RNA, 10 nt, Unknown
  source: /note="Description of Unknown: Exemplary gene or splice site sequence"
aagguuauua

SEQ ID NO: 4057 - RNA, 10 nt, Unknown
  source: /note="Description of Unknown: Exemplary gene or splice site sequence"
agaguaaagc

SEQ ID NO: 4058 - RNA, 10 nt, Unknown
  source: /note="Description of Unknown: Exemplary gene or splice site sequence"
agagugugag

SEQ ID NO: 4059 - RNA, 10 nt, Unknown
  source: /note="Description of Unknown: Exemplary gene or splice site sequence"
uaggugcgag

SEQ ID NO: 4060 - RNA, 10 nt, Unknown
  source: /note="Description of Unknown: Exemplary gene or splice site sequence"
caaguaaacg

SEQ ID NO: 4061 - RNA, 10 nt, Unknown
  source: /note="Description of Unknown: Exemplary gene or splice site sequence"
aagguacgua

SEQ ID NO: 4062 - RNA, 10 nt, Unknown
  source: /note="Description of Unknown: Exemplary gene or splice site sequence"
ccaguaugua

SEQ ID NO: 4063 - RNA, 10 nt, Unknown
  source: /note="Description of Unknown: Exemplary gene or splice site sequence"
gagguuagca

SEQ ID NO: 4064 - RNA, 10 nt, Unknown
  source: /note="Description of Unknown: Exemplary gene or splice site sequence"
gugguaagcc

SEQ ID NO: 4065 - RNA, 10 nt, Unknown
  source: /note="Description of Unknown: Exemplary gene or splice site sequence"
gauguuugug

SEQ ID NO: 4066 - RNA, 10 nt, Unknown
  source: /note="Description of Unknown: Exemplary gene or splice site sequence"
caggugucaa

SEQ ID NO: 4067 - RNA, 10 nt, Unknown
  source: /note="Description of Unknown: Exemplary gene or splice site sequence"
caggucacca

SEQ ID NO: 4068 - RNA, 10 nt, Unknown
  source: /note="Description of Unknown: Exemplary gene or splice site sequence"
ccggugagua

SEQ ID NO: 4069 - RNA, 10 nt, Unknown
  source: /note="Description of Unknown: Exemplary gene or splice site sequence"
uugguaaaua

SEQ ID NO: 4070 - RNA, 10 nt, Unknown
  source: /note="Description of Unknown: Exemplary gene or splice site sequence"
acugcaggug

SEQ ID NO: 4071 - RNA, 10 nt, Unknown
  source: /note="Description of Unknown: Exemplary gene or splice site sequence"
ggagcaagug

SEQ ID NO: 4072 - RNA, 10 nt, Unknown
  source: /note="Description of Unknown: Exemplary gene or splice site sequence"
ucggugccuc

SEQ ID NO: 4073 - RNA, 10 nt, Unknown
  source: /note="Description of Unknown: Exemplary gene or splice site sequence"
caaguaacuu

SEQ ID NO: 4074 - RNA, 10 nt, Unknown
  source: /note="Description of Unknown: Exemplary gene or splice site sequence"
ggaguaagaa

SEQ ID NO: 4075 - RNA, 10 nt, Unknown
  source: /note="Description of Unknown: Exemplary gene or splice site sequence"
augguguguc

SEQ ID NO: 4076 - RNA, 10 nt, Unknown
  source: /note="Description of Unknown: Exemplary gene or splice site sequence"
ggggugagua

SEQ ID NO: 4077 - RNA, 10 nt, Unknown
  source: /note="Description of Unknown: Exemplary gene or splice site sequence"
agggucaggu

SEQ ID NO: 4078 - RNA, 10 nt, Unknown
  source: /note="Description of Unknown: Exemplary gene or splice site sequence"
auagugaguu

SEQ ID NO: 4079 - RNA, 10 nt, Unknown
  source: /note="Description of Unknown: Exemplary gene or splice site sequence"
cccguaggcu

SEQ ID NO: 4080 - RNA, 10 nt, Unknown
  source: /note="Description of Unknown: Exemplary gene or splice site sequence"
gacgugugua

SEQ ID NO: 4081 - RNA, 10 nt, Unknown
  source: /note="Description of Unknown: Exemplary gene or splice site sequence"
gcggugagga

SEQ ID NO: 4082 - RNA, 10 nt, Unknown
  source: /note="Description of Unknown: Exemplary gene or splice site sequence"
uaaguuuagu

SEQ ID NO: 4083 - RNA, 10 nt, Unknown
  source: /note="Description of Unknown: Exemplary gene or splice site sequence"
cggguagagg

SEQ ID NO: 4084 - RNA, 10 nt, Unknown
  source: /note="Description of Unknown: Exemplary gene or splice site sequence"
gagguggggu

SEQ ID NO: 4085 - RNA, 10 nt, Unknown
  source: /note="Description of Unknown: Exemplary gene or splice site sequence"
cacguggguu

SEQ ID NO: 4086 - RNA, 10 nt, Unknown
  source: /note="Description of Unknown: Exemplary gene or splice site sequence"
acgguaauug

SEQ ID NO: 4087 - RNA, 10 nt, Unknown
  source: /note="Description of Unknown: Exemplary gene or splice site sequence"
uuggcuccaa

SEQ ID NO: 4088 - RNA, 10 nt, Unknown
  source: /note="Description of Unknown: Exemplary gene or splice site sequence"
agcguaaguu

SEQ ID NO: 4089 - RNA, 10 nt, Unknown
  source: /note="Description of Unknown: Exemplary gene or splice site sequence"
ucaguuaagu

SEQ ID NO: 4090 - RNA, 10 nt, Unknown
  source: /note="Description of Unknown: Exemplary gene or splice site sequence"
caaguacgug

SEQ ID NO: 4091 - RNA, 10 nt, Unknown
  source: /note="Description of Unknown: Exemplary gene or splice site sequence"
augguggggu

SEQ ID NO: 4092 - RNA, 10 nt, Unknown
  source: /note="Description of Unknown: Exemplary gene or splice site sequence"
cagguaauca

SEQ ID NO: 4093 - RNA, 10 nt, Unknown
  source: /note="Description of Unknown: Exemplary gene or splice site sequence"
caggccaagg

SEQ ID NO: 4094 - RNA, 10 nt, Unknown
  source: /note="Description of Unknown: Exemplary gene or splice site sequence"
guggugagag

SEQ ID NO: 4095 - RNA, 10 nt, Unknown
  source: /note="Description of Unknown: Exemplary gene or splice site sequence"
uaggcaugug

SEQ ID NO: 4096 - RNA, 10 nt, Unknown
  source: /note="Description of Unknown: Exemplary gene or splice site sequence"
uugguaccuu

SEQ ID NO: 4097 - RNA, 10 nt, Unknown
  source: /note="Description of Unknown: Exemplary gene or splice site sequence"
cuggugugcc

SEQ ID NO: 4098 - RNA, 10 nt, Unknown
  source: /note="Description of Unknown: Exemplary gene or splice site sequence"
acaguugcca

SEQ ID NO: 4099 - RNA, 10 nt, Unknown
  source: /note="Description of Unknown: Exemplary gene or splice site sequence"
uugguaauau

SEQ ID NO: 4100 - RNA, 10 nt, Unknown
  source: /note="Description of Unknown: Exemplary gene or splice site sequence"
gaggugcaug

SEQ ID NO: 4101 - RNA, 10 nt, Unknown
  source: /note="Description of Unknown: Exemplary gene or splice site sequence"
ugugugugug

SEQ ID NO: 4102 - RNA, 10 nt, Unknown
  source: /note="Description of Unknown: Exemplary gene or splice site sequence"
gcgguacaca

SEQ ID NO: 4103 - RNA, 10 nt, Unknown
  source: /note="Description of Unknown: Exemplary gene or splice site sequence"
agaguaugcu

SEQ ID NO: 4104 - RNA, 10 nt, Unknown
  source: /note="Description of Unknown: Exemplary gene or splice site sequence"
ucugugcggg

SEQ ID NO: 4105 - RNA, 10 nt, Unknown
  source: /note="Description of Unknown: Exemplary gene or splice site sequence"
gcgguuagca

SEQ ID NO: 4106 - RNA, 10 nt, Unknown
  source: /note="Description of Unknown: Exemplary gene or splice site sequence"
gaagugagua

SEQ ID NO: 4107 - RNA, 10 nt, Unknown
  source: /note="Description of Unknown: Exemplary gene or splice site sequence"
caggugacag

SEQ ID NO: 4108 - RNA, 10 nt, Unknown
  source: /note="Description of Unknown: Exemplary gene or splice site sequence"
gaggccagcc

SEQ ID NO: 4109 - RNA, 10 nt, Unknown
  source: /note="Description of Unknown: Exemplary gene or splice site sequence"
gaggucuccu

SEQ ID NO: 4110 - RNA, 10 nt, Unknown
  source: /note="Description of Unknown: Exemplary gene or splice site sequence"
cugguagggc

SEQ ID NO: 4111 - RNA, 10 nt, Unknown
  source: /note="Description of Unknown: Exemplary gene or splice site sequence"
cggguaagug

SEQ ID NO: 4112 - RNA, 10 nt, Unknown
  source: /note="Description of Unknown: Exemplary gene or splice site sequence"
cagguaaucu

SEQ ID NO: 4113 - RNA, 10 nt, Unknown
  source: /note="Description of Unknown: Exemplary gene or splice site sequence"
gugguaggua

SEQ ID NO: 4114 - RNA, 10 nt, Unknown
  source: /note="Description of Unknown: Exemplary gene or splice site sequence"
aaggccagug

SEQ ID NO: 4115 - RNA, 10 nt, Unknown
  source: /note="Description of Unknown: Exemplary gene or splice site sequence"
aaagugaauc

SEQ ID NO: 4116 - RNA, 10 nt, Unknown
  source: /note="Description of Unknown: Exemplary gene or splice site sequence"
acgguuacgu

SEQ ID NO: 4117 - RNA, 10 nt, Unknown
  source: /note="Description of Unknown: Exemplary gene or splice site sequence"
cgggugagac

SEQ ID NO: 4118 - RNA, 10 nt, Unknown
  source: /note="Description of Unknown: Exemplary gene or splice site sequence"
cuaguacgag

SEQ ID NO: 4119 - RNA, 10 nt, Unknown
  source: /note="Description of Unknown: Exemplary gene or splice site sequence"
gcugugaggu

SEQ ID NO: 4120 - RNA, 10 nt, Unknown
  source: /note="Description of Unknown: Exemplary gene or splice site sequence"
cugguaugaa

SEQ ID NO: 4121 - RNA, 10 nt, Unknown
  source: /note="Description of Unknown: Exemplary gene or splice site sequence"
gguguacgac

SEQ ID NO: 4122 - RNA, 10 nt, Unknown
  source: /note="Description of Unknown: Exemplary gene or splice site sequence"
cuugugagug

SEQ ID NO: 4123 - RNA, 10 nt, Unknown
  source: /note="Description of Unknown: Exemplary gene or splice site sequence"
ucggugagga

SEQ ID NO: 4124 - RNA, 10 nt, Unknown
  source: /note="Description of Unknown: Exemplary gene or splice site sequence"
uggguaaaca

SEQ ID NO: 4125 - RNA, 10 nt, Unknown
  source: /note="Description of Unknown: Exemplary gene or splice site sequence"
ucgguacgug

SEQ ID NO: 4126 - RNA, 10 nt, Unknown
  source: /note="Description of Unknown: Exemplary gene or splice site sequence"
uagguagcag

SEQ ID NO: 4127 - RNA, 10 nt, Unknown
  source: /note="Description of Unknown: Exemplary gene or splice site sequence"
gagguuccaa

SEQ ID NO: 4128 - RNA, 10 nt, Unknown
  source: /note="Description of Unknown: Exemplary gene or splice site sequence"
cugguaugga

SEQ ID NO: 4129 - RNA, 10 nt, Unknown
  source: /note="Description of Unknown: Exemplary gene or splice site sequence"
cagguuuccc

SEQ ID NO: 4130 - RNA, 10 nt, Unknown
  source: /note="Description of Unknown: Exemplary gene or splice site sequence"
caggucucug

SEQ ID NO: 4131 - RNA, 10 nt, Unknown
  source: /note="Description of Unknown: Exemplary gene or splice site sequence"
gcgguagggg

SEQ ID NO: 4132 - RNA, 10 nt, Unknown
  source: /note="Description of Unknown: Exemplary gene or splice site sequence"
guuguuuccc

SEQ ID NO: 4133 - RNA, 10 nt, Unknown
  source: /note="Description of Unknown: Exemplary gene or splice site sequence"
aaagcaucca

SEQ ID NO: 4134 - RNA, 10 nt, Unknown
  source: /note="Description of Unknown: Exemplary gene or splice site sequence"
aaggugcuca

SEQ ID NO: 4135 - RNA, 10 nt, Unknown
  source: /note="Description of Unknown: Exemplary gene or splice site sequence"
aagguucaac

SEQ ID NO: 4136 - RNA, 10 nt, Unknown
  source: /note="Description of Unknown: Exemplary gene or splice site sequence"
cagguuuaca

SEQ ID NO: 4137 - RNA, 10 nt, Unknown
  source: /note="Description of Unknown: Exemplary gene or splice site sequence"
uagguaagaa

SEQ ID NO: 4138 - RNA, 10 nt, Unknown
  source: /note="Description of Unknown: Exemplary gene or splice site sequence"
aggguauccu

SEQ ID NO: 4139 - RNA, 10 nt, Unknown
  source: /note="Description of Unknown: Exemplary gene or splice site sequence"
gugguaauau

SEQ ID NO: 4140 - RNA, 10 nt, Unknown
  source: /note="Description of Unknown: Exemplary gene or splice site sequence"
uggguaugga

SEQ ID NO: 4141 - RNA, 10 nt, Unknown
  source: /note="Description of Unknown: Exemplary gene or splice site sequence"
cugguuuggc

SEQ ID NO: 4142 - RNA, 10 nt, Unknown
  source: /note="Description of Unknown: Exemplary gene or splice site sequence"
augguauauc

SEQ ID NO: 4143 - RNA, 10 nt, Unknown
  source: /note="Description of Unknown: Exemplary gene or splice site sequence"
aaaguaaacu

SEQ ID NO: 4144 - RNA, 10 nt, Unknown
  source: /note="Description of Unknown: Exemplary gene or splice site sequence"
cugguauaga

SEQ ID NO: 4145 - RNA, 10 nt, Unknown
  source: /note="Description of Unknown: Exemplary gene or splice site sequence"
uagguacuug

SEQ ID NO: 4146 - RNA, 10 nt, Unknown
  source: /note="Description of Unknown: Exemplary gene or splice site sequence"
gcaguaggug

SEQ ID NO: 4147 - RNA, 10 nt, Unknown
  source: /note="Description of Unknown: Exemplary gene or splice site sequence"
aguguauguc

SEQ ID NO: 4148 - RNA, 10 nt, Unknown
  source: /note="Description of Unknown: Exemplary gene or splice site sequence"
cugguggccu

SEQ ID NO: 4149 - RNA, 10 nt, Unknown
  source: /note="Description of Unknown: Exemplary gene or splice site sequence"
uugguguaag

SEQ ID NO: 4150 - RNA, 10 nt, Unknown
  source: /note="Description of Unknown: Exemplary gene or splice site sequence"
cgggucucgg

SEQ ID NO: 4151 - RNA, 10 nt, Unknown
  source: /note="Description of Unknown: Exemplary gene or splice site sequence"
cucguuaguu

SEQ ID NO: 4152 - RNA, 10 nt, Unknown
  source: /note="Description of Unknown: Exemplary gene or splice site sequence"
caggugguca

SEQ ID NO: 4153 - RNA, 10 nt, Unknown
  source: /note="Description of Unknown: Exemplary gene or splice site sequence"
acgguaaguc

SEQ ID NO: 4154 - RNA, 10 nt, Unknown
  source: /note="Description of Unknown: Exemplary gene or splice site sequence"
acaguaaugu

SEQ ID NO: 4155 - RNA, 10 nt, Unknown
  source: /note="Description of Unknown: Exemplary gene or splice site sequence"
ccuguaaggu

SEQ ID NO: 4156 - RNA, 10 nt, Unknown
  source: /note="Description of Unknown: Exemplary gene or splice site sequence"
gagguuaagu

SEQ ID NO: 4157 - RNA, 10 nt, Unknown
  source: /note="Description of Unknown: Exemplary gene or splice site sequence"
uugguaaaca

SEQ ID NO: 4158 - RNA, 10 nt, Unknown
  source: /note="Description of Unknown: Exemplary gene or splice site sequence"
aagguagugu

SEQ ID NO: 4159 - RNA, 10 nt, Unknown
  source: /note="Description of Unknown: Exemplary gene or splice site sequence"
gagguguggc

SEQ ID NO: 4160 - RNA, 10 nt, Unknown
  source: /note="Description of Unknown: Exemplary gene or splice site sequence"
cagguacgga

SEQ ID NO: 4161 - RNA, 10 nt, Unknown
  source: /note="Description of Unknown: Exemplary gene or splice site sequence"
aaggucauca

SEQ ID NO: 4162 - RNA, 10 nt, Unknown
  source: /note="Description of Unknown: Exemplary gene or splice site sequence"
caaguaggca

SEQ ID NO: 4163 - RNA, 10 nt, Unknown
  source: /note="Description of Unknown: Exemplary gene or splice site sequence"
caggugaaac

SEQ ID NO: 4164 - RNA, 10 nt, Unknown
  source: /note="Description of Unknown: Exemplary gene or splice site sequence"
aaugcaagug

SEQ ID NO: 4165 - RNA, 10 nt, Unknown
  source: /note="Description of Unknown: Exemplary gene or splice site sequence"
cauguaauuc

SEQ ID NO: 4166 - RNA, 10 nt, Unknown
  source: /note="Description of Unknown: Exemplary gene or splice site sequence"
caggugguuu

SEQ ID NO: 4167 - RNA, 10 nt, Unknown
  source: /note="Description of Unknown: Exemplary gene or splice site sequence"
aaggucggug

SEQ ID NO: 4168 - RNA, 10 nt, Unknown
  source: /note="Description of Unknown: Exemplary gene or splice site sequence"
aguguaugga

SEQ ID NO: 4169 - RNA, 10 nt, Unknown
  source: /note="Description of Unknown: Exemplary gene or splice site sequence"
aacguaagau

SEQ ID NO: 4170 - RNA, 10 nt, Unknown
  source: /note="Description of Unknown: Exemplary gene or splice site sequence"
gugguaaggu

SEQ ID NO: 4171 - RNA, 10 nt, Unknown
  source: /note="Description of Unknown: Exemplary gene or splice site sequence"
acuguuagua

SEQ ID NO: 4172 - RNA, 10 nt, Unknown
  source: /note="Description of Unknown: Exemplary gene or splice site sequence"
uuggugagcu

SEQ ID NO: 4173 - RNA, 10 nt, Unknown
  source: /note="Description of Unknown: Exemplary gene or splice site sequence"
uguguacgua

SEQ ID NO: 4174 - RNA, 10 nt, Unknown
  source: /note="Description of Unknown: Exemplary gene or splice site sequence"
gaggucagcc

SEQ ID NO: 4175 - RNA, 10 nt, Unknown
  source: /note="Description of Unknown: Exemplary gene or splice site sequence"
gagguagaau

SEQ ID NO: 4176 - RNA, 10 nt, Unknown
  source: /note="Description of Unknown: Exemplary gene or splice site sequence"
uguguaacac

SEQ ID NO: 4177 - RNA, 10 nt, Unknown
  source: /note="Description of Unknown: Exemplary gene or splice site sequence"
aguguaaggc

SEQ ID NO: 4178 - RNA, 10 nt, Unknown
  source: /note="Description of Unknown: Exemplary gene or splice site sequence"
gaggucugcu

SEQ ID NO: 4179 - RNA, 10 nt, Unknown
  source: /note="Description of Unknown: Exemplary gene or splice site sequence"
aacguaagcu

SEQ ID NO: 4180 - RNA, 10 nt, Unknown
  source: /note="Description of Unknown: Exemplary gene or splice site sequence"
caggucugca

SEQ ID NO: 4181 - RNA, 10 nt, Unknown
  source: /note="Description of Unknown: Exemplary gene or splice site sequence"
gccgugagcc

SEQ ID NO: 4182 - RNA, 10 nt, Unknown
  source: /note="Description of Unknown: Exemplary gene or splice site sequence"
caggcaacuu

SEQ ID NO: 4183 - RNA, 10 nt, Unknown
  source: /note="Description of Unknown: Exemplary gene or splice site sequence"
caggugcgcu

SEQ ID NO: 4184 - RNA, 10 nt, Unknown
  source: /note="Description of Unknown: Exemplary gene or splice site sequence"
cggguaaacc

SEQ ID NO: 4185 - RNA, 10 nt, Unknown
  source: /note="Description of Unknown: Exemplary gene or splice site sequence"
ccggucaguc

SEQ ID NO: 4186 - RNA, 10 nt, Unknown
  source: /note="Description of Unknown: Exemplary gene or splice site sequence"
uaggugggcg

SEQ ID NO: 4187 - RNA, 10 nt, Unknown
  source: /note="Description of Unknown: Exemplary gene or splice site sequence"
gcggucaguu

SEQ ID NO: 4188 - RNA, 10 nt, Unknown
  source: /note="Description of Unknown: Exemplary gene or splice site sequence"
gggguggguc

SEQ ID NO: 4189 - RNA, 10 nt, Unknown
  source: /note="Description of Unknown: Exemplary gene or splice site sequence"
agcguaauag

SEQ ID NO: 4190 - RNA, 10 nt, Unknown
  source: /note="Description of Unknown: Exemplary gene or splice site sequence"
acggugaguc

SEQ ID NO: 4191 - RNA, 10 nt, Unknown
  source: /note="Description of Unknown: Exemplary gene or splice site sequence"
cagguuggua

SEQ ID NO: 4192 - RNA, 10 nt, Unknown
  source: /note="Description of Unknown: Exemplary gene or splice site sequence"
gagguggcuu

SEQ ID NO: 4193 - RNA, 10 nt, Unknown
  source: /note="Description of Unknown: Exemplary gene or splice site sequence"
auaguauuga

SEQ ID NO: 4194 - RNA, 10 nt, Unknown
  source: /note="Description of Unknown: Exemplary gene or splice site sequence"
ugagucgucc

SEQ ID NO: 4195 - RNA, 10 nt, Unknown
  source: /note="Description of Unknown: Exemplary gene or splice site sequence"
caggugcucu

SEQ ID NO: 4196 - RNA, 10 nt, Unknown
  source: /note="Description of Unknown: Exemplary gene or splice site sequence"
uacguaauau

SEQ ID NO: 4197 - RNA, 10 nt, Unknown
  source: /note="Description of Unknown: Exemplary gene or splice site sequence"
gcuguccuga

SEQ ID NO: 4198 - RNA, 10 nt, Unknown
  source: /note="Description of Unknown: Exemplary gene or splice site sequence"
caggcugcac

SEQ ID NO: 4199 - RNA, 10 nt, Unknown
  source: /note="Description of Unknown: Exemplary gene or splice site sequence"
gcgguaagaa

SEQ ID NO: 4200 - RNA, 10 nt, Unknown
  source: /note="Description of Unknown: Exemplary gene or splice site sequence"
uaaguuacuu

SEQ ID NO: 4201 - RNA, 10 nt, Unknown
  source: /note="Description of Unknown: Exemplary gene or splice site sequence"
uaaguaaaua

SEQ ID NO: 4202 - RNA, 10 nt, Unknown
  source: /note="Description of Unknown: Exemplary gene or splice site sequence"
gggguauaac

SEQ ID NO: 4203 - RNA, 10 nt, Unknown
  source: /note="Description of Unknown: Exemplary gene or splice site sequence"
gaggugcauu

SEQ ID NO: 4204 - RNA, 10 nt, Unknown
  source: /note="Description of Unknown: Exemplary gene or splice site sequence"
ucgguaaugu

SEQ ID NO: 4205 - RNA, 10 nt, Unknown
  source: /note="Description of Unknown: Exemplary gene or splice site sequence"
gaggcacgga

SEQ ID NO: 4206 - RNA, 10 nt, Unknown
  source: /note="Description of Unknown: Exemplary gene or splice site sequence"
agggugugga

SEQ ID NO: 4207 - RNA, 10 nt, Unknown
  source: /note="Description of Unknown: Exemplary gene or splice site sequence"
uggguauaug

SEQ ID NO: 4208 - RNA, 10 nt, Unknown
  source: /note="Description of Unknown: Exemplary gene or splice site sequence"
ugagugagac

SEQ ID NO: 4209 - RNA, 10 nt, Unknown
  source: /note="Description of Unknown: Exemplary gene or splice site sequence"
aaggcaaagg

SEQ ID NO: 4210 - RNA, 10 nt, Unknown
  source: /note="Description of Unknown: Exemplary gene or splice site sequence"
aguguuuguu

SEQ ID NO: 4211 - RNA, 10 nt, Unknown
  source: /note="Description of Unknown: Exemplary gene or splice site sequence"
augguauugg

SEQ ID NO: 4212 - RNA, 10 nt, Unknown
  source: /note="Description of Unknown: Exemplary gene or splice site sequence"
caggugcugu

SEQ ID NO: 4213 - RNA, 10 nt, Unknown
  source: /note="Description of Unknown: Exemplary gene or splice site sequence"
gagguccgcg

SEQ ID NO: 4214 - RNA, 10 nt, Unknown
  source: /note="Description of Unknown: Exemplary gene or splice site sequence"
auggcaagcu

SEQ ID NO: 4215 - RNA, 10 nt, Unknown
  source: /note="Description of Unknown: Exemplary gene or splice site sequence"
ucgguaauau

SEQ ID NO: 4216 - RNA, 10 nt, Unknown
  source: /note="Description of Unknown: Exemplary gene or splice site sequence"
caggcaacaa

SEQ ID NO: 4217 - RNA, 10 nt, Unknown
  source: /note="Description of Unknown: Exemplary gene or splice site sequence"
cuggucucgc

SEQ ID NO: 4218 - RNA, 10 nt, Unknown
  source: /note="Description of Unknown: Exemplary gene or splice site sequence"
uagguaacga

SEQ ID NO: 4219 - RNA, 10 nt, Unknown
  source: /note="Description of Unknown: Exemplary gene or splice site sequence"
cggguaaggu

SEQ ID NO: 4220 - RNA, 10 nt, Unknown
  source: /note="Description of Unknown: Exemplary gene or splice site sequence"
uagguaaugc

SEQ ID NO: 4221 - RNA, 10 nt, Unknown
  source: /note="Description of Unknown: Exemplary gene or splice site sequence"
acaguaggua

SEQ ID NO: 4222 - RNA, 10 nt, Unknown
  source: /note="Description of Unknown: Exemplary gene or splice site sequence"
gcuguucgaa

SEQ ID NO: 4223 - RNA, 10 nt, Unknown
  source: /note="Description of Unknown: Exemplary gene or splice site sequence"
aagguuaugc

SEQ ID NO: 4224 - RNA, 10 nt, Unknown
  source: /note="Description of Unknown: Exemplary gene or splice site sequence"
agaguuaguu

SEQ ID NO: 4225 - RNA, 10 nt, Unknown
  source: /note="Description of Unknown: Exemplary gene or splice site sequence"
ugagugugcg

SEQ ID NO: 4226 - RNA, 10 nt, Unknown
  source: /note="Description of Unknown: Exemplary gene or splice site sequence"
caugugcuuu

SEQ ID NO: 4227 - RNA, 10 nt, Unknown
  source: /note="Description of Unknown: Exemplary gene or splice site sequence"
aggguguguu

SEQ ID NO: 4228 - RNA, 10 nt, Unknown
  source: /note="Description of Unknown: Exemplary gene or splice site sequence"
acaguuaagg

SEQ ID NO: 4229 - RNA, 10 nt, Unknown
  source: /note="Description of Unknown: Exemplary gene or splice site sequence"
acagugaggg

SEQ ID NO: 4230 - RNA, 10 nt, Unknown
  source: /note="Description of Unknown: Exemplary gene or splice site sequence"
gauguauacc

SEQ ID NO: 4231 - RNA, 10 nt, Unknown
  source: /note="Description of Unknown: Exemplary gene or splice site sequence"
uuaguaagcu

SEQ ID NO: 4232 - RNA, 10 nt, Unknown
  source: /note="Description of Unknown: Exemplary gene or splice site sequence"
agagcugcgu

SEQ ID NO: 4233 - RNA, 10 nt, Unknown
  source: /note="Description of Unknown: Exemplary gene or splice site sequence"
aaggugaaaa

SEQ ID NO: 4234 - RNA, 10 nt, Unknown
  source: /note="Description of Unknown: Exemplary gene or splice site sequence"
aagguaccua

SEQ ID NO: 4235 - RNA, 10 nt, Unknown
  source: /note="Description of Unknown: Exemplary gene or splice site sequence"
gagguaucag

SEQ ID NO: 4236 - RNA, 10 nt, Unknown
  source: /note="Description of Unknown: Exemplary gene or splice site sequence"
augguaugua

SEQ ID NO: 4237 - RNA, 10 nt, Unknown
  source: /note="Description of Unknown: Exemplary gene or splice site sequence"
uuggugagcc

SEQ ID NO: 4238 - RNA, 10 nt, Unknown
  source: /note="Description of Unknown: Exemplary gene or splice site sequence"
cagguaccga

SEQ ID NO: 4239 - RNA, 10 nt, Unknown
  source: /note="Description of Unknown: Exemplary gene or splice site sequence"
agaguaaacu

SEQ ID NO: 4240 - RNA, 10 nt, Unknown
  source: /note="Description of Unknown: Exemplary gene or splice site sequence"
aaggugcaua

SEQ ID NO: 4241 - RNA, 10 nt, Unknown
  source: /note="Description of Unknown: Exemplary gene or splice site sequence"
ccggugugug

SEQ ID NO: 4242 - RNA, 10 nt, Unknown
  source: /note="Description of Unknown: Exemplary gene or splice site sequence"
gggguuuggc

SEQ ID NO: 4243 - RNA, 10 nt, Unknown
  source: /note="Description of Unknown: Exemplary gene or splice site sequence"
uugguaacca

SEQ ID NO: 4244 - RNA, 10 nt, Unknown
  source: /note="Description of Unknown: Exemplary gene or splice site sequence"
ucuguuggua

SEQ ID NO: 4245 - RNA, 10 nt, Unknown
  source: /note="Description of Unknown: Exemplary gene or splice site sequence"
uugguauguc

SEQ ID NO: 4246 - RNA, 10 nt, Unknown
  source: /note="Description of Unknown: Exemplary gene or splice site sequence"
aaggugcguc

SEQ ID NO: 4247 - RNA, 10 nt, Unknown
  source: /note="Description of Unknown: Exemplary gene or splice site sequence"
uuuguaagcc

SEQ ID NO: 4248 - RNA, 10 nt, Unknown
  source: /note="Description of Unknown: Exemplary gene or splice site sequence"
cugguaaacu

SEQ ID NO: 4249 - RNA, 10 nt, Unknown
  source: /note="Description of Unknown: Exemplary gene or splice site sequence"
ucgguaauuu

SEQ ID NO: 4250 - RNA, 10 nt, Unknown
  source: /note="Description of Unknown: Exemplary gene or splice site sequence"
cugguaggcu

SEQ ID NO: 4251 - RNA, 10 nt, Unknown
  source: /note="Description of Unknown: Exemplary gene or splice site sequence"
gaggucugua

SEQ ID NO: 4252 - RNA, 10 nt, Unknown
  source: /note="Description of Unknown: Exemplary gene or splice site sequence"
cugguaaagg

SEQ ID NO: 4253 - RNA, 10 nt, Unknown
  source: /note="Description of Unknown: Exemplary gene or splice site sequence"
cagguguggu

SEQ ID NO: 4254 - RNA, 10 nt, Unknown
  source: /note="Description of Unknown: Exemplary gene or splice site sequence"
ucgguacguc

SEQ ID NO: 4255 - RNA, 10 nt, Unknown
  source: /note="Description of Unknown: Exemplary gene or splice site sequence"
caggugccag

SEQ ID NO: 4256 - RNA, 10 nt, Unknown
  source: /note="Description of Unknown: Exemplary gene or splice site sequence"
acagcuagua

SEQ ID NO: 4257 - RNA, 10 nt, Unknown
  source: /note="Description of Unknown: Exemplary gene or splice site sequence"
aagguauagc

SEQ ID NO: 4258 - RNA, 10 nt, Unknown
  source: /note="Description of Unknown: Exemplary gene or splice site sequence"
cugguaggag

SEQ ID NO: 4259 - RNA, 10 nt, Unknown
  source: /note="Description of Unknown: Exemplary gene or splice site sequence"
gcuguacgua

SEQ ID NO: 4260 - RNA, 10 nt, Unknown
  source: /note="Description of Unknown: Exemplary gene or splice site sequence"
caagcacgag

SEQ ID NO: 4261 - RNA, 10 nt, Unknown
  source: /note="Description of Unknown: Exemplary gene or splice site sequence"
cuaguaagac

SEQ ID NO: 4262 - RNA, 10 nt, Unknown
  source: /note="Description of Unknown: Exemplary gene or splice site sequence"
cccguaagcg

SEQ ID NO: 4263 - RNA, 10 nt, Unknown
  source: /note="Description of Unknown: Exemplary gene or splice site sequence"
gagguccagg

SEQ ID NO: 4264 - RNA, 10 nt, Unknown
  source: /note="Description of Unknown: Exemplary gene or splice site sequence"
aagguggggc

SEQ ID NO: 4265 - RNA, 10 nt, Unknown
  source: /note="Description of Unknown: Exemplary gene or splice site sequence"
cagguaaacg

SEQ ID NO: 4266 - RNA, 10 nt, Unknown
  source: /note="Description of Unknown: Exemplary gene or splice site sequence"
ucgguaacuu

SEQ ID NO: 4267 - RNA, 10 nt, Unknown
  source: /note="Description of Unknown: Exemplary gene or splice site sequence"
gaggugcgca

SEQ ID NO: 4268 - RNA, 10 nt, Unknown
  source: /note="Description of Unknown: Exemplary gene or splice site sequence"
acggugugac

SEQ ID NO: 4269 - RNA, 10 nt, Unknown
  source: /note="Description of Unknown: Exemplary gene or splice site sequence"
gugguaugug

SEQ ID NO: 4270 - RNA, 10 nt, Unknown
  source: /note="Description of Unknown: Exemplary gene or splice site sequence"
aaaguaucug

SEQ ID NO: 4271 - RNA, 10 nt, Unknown
  source: /note="Description of Unknown: Exemplary gene or splice site sequence"
cggguaugua

SEQ ID NO: 4272 - RNA, 10 nt, Unknown
  source: /note="Description of Unknown: Exemplary gene or splice site sequence"
aaaguauuua

SEQ ID NO: 4273 - RNA, 10 nt, Unknown
  source: /note="Description of Unknown: Exemplary gene or splice site sequence"
acgguaugag

SEQ ID NO: 4274 - RNA, 10 nt, Unknown
  source: /note="Description of Unknown: Exemplary gene or splice site sequence"
agaguaaaau

SEQ ID NO: 4275 - RNA, 10 nt, Unknown
  source: /note="Description of Unknown: Exemplary gene or splice site sequence"
gcuguauggc

SEQ ID NO: 4276 - RNA, 10 nt, Unknown
  source: /note="Description of Unknown: Exemplary gene or splice site sequence"
gcaguaauaa

SEQ ID NO: 4277 - RNA, 10 nt, Unknown
  source: /note="Description of Unknown: Exemplary gene or splice site sequence"
uaaguauuua

SEQ ID NO: 4278 - RNA, 10 nt, Unknown
  source: /note="Description of Unknown: Exemplary gene or splice site sequence"
auugcaggag

SEQ ID NO: 4279 - RNA, 10 nt, Unknown
  source: /note="Description of Unknown: Exemplary gene or splice site sequence"
ccgguaagaa

SEQ ID NO: 4280 - RNA, 10 nt, Unknown
  source: /note="Description of Unknown: Exemplary gene or splice site sequence"
gagguuuguc

SEQ ID NO: 4281 - RNA, 10 nt, Unknown
  source: /note="Description of Unknown: Exemplary gene or splice site sequence"
aaaguaugag

SEQ ID NO: 4282 - RNA, 10 nt, Unknown
  source: /note="Description of Unknown: Exemplary gene or splice site sequence"
gauguuagua

SEQ ID NO: 4283 - RNA, 10 nt, Unknown
  source: /note="Description of Unknown: Exemplary gene or splice site sequence"
aagguaccga

SEQ ID NO: 4284 - RNA, 10 nt, Unknown
  source: /note="Description of Unknown: Exemplary gene or splice site sequence"
ccaguaauua

SEQ ID NO: 4285 - RNA, 10 nt, Unknown
  source: /note="Description of Unknown: Exemplary gene or splice site sequence"
gugguaugcg

SEQ ID NO: 4286 - RNA, 10 nt, Unknown
  source: /note="Description of Unknown: Exemplary gene or splice site sequence"
auggugcgcu

SEQ ID NO: 4287 - RNA, 10 nt, Unknown
  source: /note="Description of Unknown: Exemplary gene or splice site sequence"
caggucuaug

SEQ ID NO: 4288 - RNA, 10 nt, Unknown
  source: /note="Description of Unknown: Exemplary gene or splice site sequence"
cuaguaagau

SEQ ID NO: 4289 - RNA, 10 nt, Unknown
  source: /note="Description of Unknown: Exemplary gene or splice site sequence"
gagguaacgu

SEQ ID NO: 4290 - RNA, 10 nt, Unknown
  source: /note="Description of Unknown: Exemplary gene or splice site sequence"
cuggucccgg

SEQ ID NO: 4291 - RNA, 10 nt, Unknown
  source: /note="Description of Unknown: Exemplary gene or splice site sequence"
gagguccuuc

SEQ ID NO: 4292 - RNA, 10 nt, Unknown
  source: /note="Description of Unknown: Exemplary gene or splice site sequence"
acggucaccc

SEQ ID NO: 4293 - RNA, 10 nt, Unknown
  source: /note="Description of Unknown: Exemplary gene or splice site sequence"
augguaauag

SEQ ID NO: 4294 - RNA, 10 nt, Unknown
  source: /note="Description of Unknown: Exemplary gene or splice site sequence"
uuuguaacac

SEQ ID NO: 4295 - RNA, 10 nt, Unknown
  source: /note="Description of Unknown: Exemplary gene or splice site sequence"
uggguaugau

SEQ ID NO: 4296 - RNA, 10 nt, Unknown
  source: /note="Description of Unknown: Exemplary gene or splice site sequence"
caggcccccc

SEQ ID NO: 4297 - RNA, 10 nt, Unknown
  source: /note="Description of Unknown: Exemplary gene or splice site sequence"
agaguaguaa

SEQ ID NO: 4298 - RNA, 10 nt, Unknown
  source: /note="Description of Unknown: Exemplary gene or splice site sequence"
uggguugguu

SEQ ID NO: 4299 - RNA, 10 nt, Unknown
  source: /note="Description of Unknown: Exemplary gene or splice site sequence"
gaggugcggc

SEQ ID NO: 4300 - RNA, 10 nt, Unknown
  source: /note="Description of Unknown: Exemplary gene or splice site sequence"
ucuguacggg

SEQ ID NO: 4301 - RNA, 10 nt, Unknown
  source: /note="Description of Unknown: Exemplary gene or splice site sequence"
cgggugcgug

SEQ ID NO: 4302 - RNA, 10 nt, Unknown
  source: /note="Description of Unknown: Exemplary gene or splice site sequence"
cauguaagga

SEQ ID NO: 4303 - RNA, 10 nt, Unknown
  source: /note="Description of Unknown: Exemplary gene or splice site sequence"
gauguaugcu

SEQ ID NO: 4304 - RNA, 10 nt, Unknown
  source: /note="Description of Unknown: Exemplary gene or splice site sequence"
ucugcaauuc

SEQ ID NO: 4305 - RNA, 10 nt, Unknown
  source: /note="Description of Unknown: Exemplary gene or splice site sequence"
uugguggggg

SEQ ID NO: 4306 - RNA, 10 nt, Unknown
  source: /note="Description of Unknown: Exemplary gene or splice site sequence"
ugagcucaaa

SEQ ID NO: 4307 - RNA, 10 nt, Unknown
  source: /note="Description of Unknown: Exemplary gene or splice site sequence"
ucgguaugua

SEQ ID NO: 4308 - RNA, 10 nt, Unknown
  source: /note="Description of Unknown: Exemplary gene or splice site sequence"
uaaguaugcc

SEQ ID NO: 4309 - RNA, 10 nt, Unknown
  source: /note="Description of Unknown: Exemplary gene or splice site sequence"
cagguuugca

SEQ ID NO: 4310 - RNA, 10 nt, Unknown
  source: /note="Description of Unknown: Exemplary gene or splice site sequence"
acggugagag

SEQ ID NO: 4311 - RNA, 10 nt, Unknown
  source: /note="Description of Unknown: Exemplary gene or splice site sequence"
cagguguuuu

SEQ ID NO: 4312 - RNA, 10 nt, Unknown
  source: /note="Description of Unknown: Exemplary gene or splice site sequence"
guggugagcc

SEQ ID NO: 4313 - RNA, 10 nt, Unknown
  source: /note="Description of Unknown: Exemplary gene or splice site sequence"
aggguacaua

SEQ ID NO: 4314 - RNA, 10 nt, Unknown
  source: /note="Description of Unknown: Exemplary gene or splice site sequence"
uagguaaccc

SEQ ID NO: 4315 - RNA, 10 nt, Unknown
  source: /note="Description of Unknown: Exemplary gene or splice site sequence"
guggucagua

SEQ ID NO: 4316 - RNA, 10 nt, Unknown
  source: /note="Description of Unknown: Exemplary gene or splice site sequence"
cuggugagcc

SEQ ID NO: 4317 - RNA, 10 nt, Unknown
  source: /note="Description of Unknown: Exemplary gene or splice site sequence"
auagucguga

SEQ ID NO: 4318 - RNA, 10 nt, Unknown
  source: /note="Description of Unknown: Exemplary gene or splice site sequence"
gaggucaaaa

SEQ ID NO: 4319 - RNA, 10 nt, Unknown
  source: /note="Description of Unknown: Exemplary gene or splice site sequence"
cguguagcuu

SEQ ID NO: 4320 - RNA, 10 nt, Unknown
  source: /note="Description of Unknown: Exemplary gene or splice site sequence"
cagguguuug

SEQ ID NO: 4321 - RNA, 10 nt, Unknown
  source: /note="Description of Unknown: Exemplary gene or splice site sequence"
cagguuggac

SEQ ID NO: 4322 - RNA, 10 nt, Unknown
  source: /note="Description of Unknown: Exemplary gene or splice site sequence"
cagguaagcu

SEQ ID NO: 4323 - RNA, 10 nt, Unknown
  source: /note="Description of Unknown: Exemplary gene or splice site sequence"
agggucagaa

SEQ ID NO: 4324 - RNA, 10 nt, Unknown
  source: /note="Description of Unknown: Exemplary gene or splice site sequence"
cacguauguc

SEQ ID NO: 4325 - RNA, 10 nt, Unknown
  source: /note="Description of Unknown: Exemplary gene or splice site sequence"
gggguacgga

SEQ ID NO: 4326 - RNA, 10 nt, Unknown
  source: /note="Description of Unknown: Exemplary gene or splice site sequence"
aaggcaggac

SEQ ID NO: 4327 - RNA, 10 nt, Unknown
  source: /note="Description of Unknown: Exemplary gene or splice site sequence"
gaggugaagc

SEQ ID NO: 4328 - RNA, 10 nt, Unknown
  source: /note="Description of Unknown: Exemplary gene or splice site sequence"
gagguuugaa

SEQ ID NO: 4329 - RNA, 10 nt, Unknown
  source: /note="Description of Unknown: Exemplary gene or splice site sequence"
gaggcaggug

SEQ ID NO: 4330 - RNA, 10 nt, Unknown
  source: /note="Description of Unknown: Exemplary gene or splice site sequence"
gagguucgga

SEQ ID NO: 4331 - RNA, 10 nt, Unknown
  source: /note="Description of Unknown: Exemplary gene or splice site sequence"
caggugauac

SEQ ID NO: 4332 - RNA, 10 nt, Unknown
  source: /note="Description of Unknown: Exemplary gene or splice site sequence"
aggguggggg

SEQ ID NO: 4333 - RNA, 10 nt, Unknown
  source: /note="Description of Unknown: Exemplary gene or splice site sequence"
ugggugaaca

SEQ ID NO: 4334 - RNA, 10 nt, Unknown
  source: /note="Description of Unknown: Exemplary gene or splice site sequence"
uagguacugc

SEQ ID NO: 4335 - RNA, 10 nt, Unknown
  source: /note="Description of Unknown: Exemplary gene or splice site sequence"
caggcuccug

SEQ ID NO: 4336 - RNA, 10 nt, Unknown
  source: /note="Description of Unknown: Exemplary gene or splice site sequence"
gagguacauc

SEQ ID NO: 4337 - RNA, 10 nt, Unknown
  source: /note="Description of Unknown: Exemplary gene or splice site sequence"
cuaguaggug

SEQ ID NO: 4338 - RNA, 10 nt, Unknown
  source: /note="Description of Unknown: Exemplary gene or splice site sequence"
gaggcaagga

SEQ ID NO: 4339 - RNA, 10 nt, Unknown
  source: /note="Description of Unknown: Exemplary gene or splice site sequence"
aaggcaagac

SEQ ID NO: 4340 - RNA, 10 nt, Unknown
  source: /note="Description of Unknown: Exemplary gene or splice site sequence"
aaagugcggu

SEQ ID NO: 4341 - RNA, 10 nt, Unknown
  source: /note="Description of Unknown: Exemplary gene or splice site sequence"
gagguuaaug

SEQ ID NO: 4342 - RNA, 10 nt, Unknown
  source: /note="Description of Unknown: Exemplary gene or splice site sequence"
gcaguaagca

SEQ ID NO: 4343 - RNA, 10 nt, Unknown
  source: /note="Description of Unknown: Exemplary gene or splice site sequence"
aaggcaagca

SEQ ID NO: 4344 - RNA, 10 nt, Unknown
  source: /note="Description of Unknown: Exemplary gene or splice site sequence"
acaguaagcu

SEQ ID NO: 4345 - RNA, 10 nt, Unknown
  source: /note="Description of Unknown: Exemplary gene or splice site sequence"
aaaguacgua

SEQ ID NO: 4346 - RNA, 10 nt, Unknown
  source: /note="Description of Unknown: Exemplary gene or splice site sequence"
cugguuaguc

SEQ ID NO: 4347 - RNA, 10 nt, Unknown
  source: /note="Description of Unknown: Exemplary gene or splice site sequence"
gaggugacgc

SEQ ID NO: 4348 - RNA, 10 nt, Unknown
  source: /note="Description of Unknown: Exemplary gene or splice site sequence"
acaguaagga

SEQ ID NO: 4349 - RNA, 10 nt, Unknown
  source: /note="Description of Unknown: Exemplary gene or splice site sequence"
aauguacuua

SEQ ID NO: 4350 - RNA, 10 nt, Unknown
  source: /note="Description of Unknown: Exemplary gene or splice site sequence"
gggguacagu

SEQ ID NO: 4351 - RNA, 10 nt, Unknown
  source: /note="Description of Unknown: Exemplary gene or splice site sequence"
cguguaugug

SEQ ID NO: 4352 - RNA, 10 nt, Unknown
  source: /note="Description of Unknown: Exemplary gene or splice site sequence"
uccguagguu

SEQ ID NO: 4353 - RNA, 10 nt, Unknown
  source: /note="Description of Unknown: Exemplary gene or splice site sequence"
gagguggucg

SEQ ID NO: 4354 - RNA, 10 nt, Unknown
  source: /note="Description of Unknown: Exemplary gene or splice site sequence"
ucagugaguc

SEQ ID NO: 4355 - RNA, 10 nt, Unknown
  source: /note="Description of Unknown: Exemplary gene or splice site sequence"
gagguaauua

SEQ ID NO: 4356 - RNA, 10 nt, Unknown
  source: /note="Description of Unknown: Exemplary gene or splice site sequence"
ucugugagca

SEQ ID NO: 4357 - RNA, 10 nt, Unknown
  source: /note="Description of Unknown: Exemplary gene or splice site sequence"
gaaguucgug

SEQ ID NO: 4358 - RNA, 10 nt, Unknown
  source: /note="Description of Unknown: Exemplary gene or splice site sequence"
acggugaggc

SEQ ID NO: 4359 - RNA, 10 nt, Unknown
  source: /note="Description of Unknown: Exemplary gene or splice site sequence"
uagguaguug

SEQ ID NO: 4360 - RNA, 10 nt, Unknown
  source: /note="Description of Unknown: Exemplary gene or splice site sequence"
ggugucuggg

SEQ ID NO: 4361 - RNA, 10 nt, Unknown
  source: /note="Description of Unknown: Exemplary gene or splice site sequence"
ugugugaguu

SEQ ID NO: 4362 - RNA, 10 nt, Unknown
  source: /note="Description of Unknown: Exemplary gene or splice site sequence"
aauguaggag

SEQ ID NO: 4363 - RNA, 10 nt, Unknown
  source: /note="Description of Unknown: Exemplary gene or splice site sequence"
gaggcacguc

SEQ ID NO: 4364 - RNA, 10 nt, Unknown
  source: /note="Description of Unknown: Exemplary gene or splice site sequence"
caaguacauu

SEQ ID NO: 4365 - RNA, 10 nt, Unknown
  source: /note="Description of Unknown: Exemplary gene or splice site sequence"
uugguacaga

SEQ ID NO: 4366 - RNA, 10 nt, Unknown
  source: /note="Description of Unknown: Exemplary gene or splice site sequence"
uuggucagug

SEQ ID NO: 4367 - RNA, 10 nt, Unknown
  source: /note="Description of Unknown: Exemplary gene or splice site sequence"
ggugugggcc

SEQ ID NO: 4368 - RNA, 10 nt, Unknown
  source: /note="Description of Unknown: Exemplary gene or splice site sequence"
cgggugagcu

SEQ ID NO: 4369 - RNA, 10 nt, Unknown
  source: /note="Description of Unknown: Exemplary gene or splice site sequence"
acagugagag

SEQ ID NO: 4370 - RNA, 10 nt, Unknown
  source: /note="Description of Unknown: Exemplary gene or splice site sequence"
auaguagguu

SEQ ID NO: 4371 - RNA, 10 nt, Unknown
  source: /note="Description of Unknown: Exemplary gene or splice site sequence"
cagguccgug

SEQ ID NO: 4372 - RNA, 10 nt, Unknown
  source: /note="Description of Unknown: Exemplary gene or splice site sequence"
gaggcaggua

SEQ ID NO: 4373 - RNA, 10 nt, Unknown
  source: /note="Description of Unknown: Exemplary gene or splice site sequence"
augguggaag

SEQ ID NO: 4374 - RNA, 10 nt, Unknown
  source: /note="Description of Unknown: Exemplary gene or splice site sequence"
auggugggcg

SEQ ID NO: 4375 - RNA, 10 nt, Unknown
  source: /note="Description of Unknown: Exemplary gene or splice site sequence"
caaguaagca

SEQ ID NO: 4376 - RNA, 10 nt, Unknown
  source: /note="Description of Unknown: Exemplary gene or splice site sequence"
cccgugggua

SEQ ID NO: 4377 - RNA, 10 nt, Unknown
  source: /note="Description of Unknown: Exemplary gene or splice site sequence"
cagguagaau

SEQ ID NO: 4378 - RNA, 10 nt, Unknown
  source: /note="Description of Unknown: Exemplary gene or splice site sequence"
caggcugagc

SEQ ID NO: 4379 - RNA, 10 nt, Unknown
  source: /note="Description of Unknown: Exemplary gene or splice site sequence"
cugguggccc

SEQ ID NO: 4380 - RNA, 10 nt, Unknown
  source: /note="Description of Unknown: Exemplary gene or splice site sequence"
ugaguaagag

SEQ ID NO: 4381 - RNA, 10 nt, Unknown
  source: /note="Description of Unknown: Exemplary gene or splice site sequence"
cacguuagcu

SEQ ID NO: 4382 - RNA, 10 nt, Unknown
  source: /note="Description of Unknown: Exemplary gene or splice site sequence"
aagguagcuc

SEQ ID NO: 4383 - RNA, 10 nt, Unknown
  source: /note="Description of Unknown: Exemplary gene or splice site sequence"
ucggugaguu

SEQ ID NO: 4384 - RNA, 10 nt, Unknown
  source: /note="Description of Unknown: Exemplary gene or splice site sequence"
gaggcccuuc

SEQ ID NO: 4385 - RNA, 10 nt, Unknown
  source: /note="Description of Unknown: Exemplary gene or splice site sequence"
cagguuaugc

SEQ ID NO: 4386 - RNA, 10 nt, Unknown
  source: /note="Description of Unknown: Exemplary gene or splice site sequence"
ccuguaagcu

SEQ ID NO: 4387 - RNA, 10 nt, Unknown
  source: /note="Description of Unknown: Exemplary gene or splice site sequence"
caggucuccu

SEQ ID NO: 4388 - RNA, 10 nt, Unknown
  source: /note="Description of Unknown: Exemplary gene or splice site sequence"
uagguaggcu

SEQ ID NO: 4389 - RNA, 10 nt, Unknown
  source: /note="Description of Unknown: Exemplary gene or splice site sequence"
gggguagggg

SEQ ID NO: 4390 - RNA, 10 nt, Unknown
  source: /note="Description of Unknown: Exemplary gene or splice site sequence"
aagguaguga

SEQ ID NO: 4391 - RNA, 10 nt, Unknown
  source: /note="Description of Unknown: Exemplary gene or splice site sequence"
gagguuguug

SEQ ID NO: 4392 - RNA, 10 nt, Unknown
  source: /note="Description of Unknown: Exemplary gene or splice site sequence"
ugggugugau

SEQ ID NO: 4393 - RNA, 10 nt, Unknown
  source: /note="Description of Unknown: Exemplary gene or splice site sequence"
cccguaacua

SEQ ID NO: 4394 - RNA, 10 nt, Unknown
  source: /note="Description of Unknown: Exemplary gene or splice site sequence"
aaagcuggug

SEQ ID NO: 4395 - RNA, 10 nt, Unknown
  source: /note="Description of Unknown: Exemplary gene or splice site sequence"
gagguauagu

SEQ ID NO: 4396 - RNA, 10 nt, Unknown
  source: /note="Description of Unknown: Exemplary gene or splice site sequence"
acgguaagag

SEQ ID NO: 4397 - RNA, 10 nt, Unknown
  source: /note="Description of Unknown: Exemplary gene or splice site sequence"
gaggccaguu

SEQ ID NO: 4398 - RNA, 10 nt, Unknown
  source: /note="Description of Unknown: Exemplary gene or splice site sequence"
ucggugggag

SEQ ID NO: 4399 - RNA, 10 nt, Unknown
  source: /note="Description of Unknown: Exemplary gene or splice site sequence"
ccaguguggc

SEQ ID NO: 4400 - RNA, 10 nt, Unknown
  source: /note="Description of Unknown: Exemplary gene or splice site sequence"
ucuguagguc

SEQ ID NO: 4401 - RNA, 10 nt, Unknown
  source: /note="Description of Unknown: Exemplary gene or splice site sequence"
aaggucaauu

SEQ ID NO: 4402 - RNA, 10 nt, Unknown
  source: /note="Description of Unknown: Exemplary gene or splice site sequence"
gucguaagaa

SEQ ID NO: 4403 - RNA, 10 nt, Unknown
  source: /note="Description of Unknown: Exemplary gene or splice site sequence"
gcgguaaguc

SEQ ID NO: 4404 - RNA, 10 nt, Unknown
  source: /note="Description of Unknown: Exemplary gene or splice site sequence"
cugguagagc

SEQ ID NO: 4405 - RNA, 10 nt, Unknown
  source: /note="Description of Unknown: Exemplary gene or splice site sequence"
gaggucgguc

SEQ ID NO: 4406 - RNA, 10 nt, Unknown
  source: /note="Description of Unknown: Exemplary gene or splice site sequence"
caggucgucu

SEQ ID NO: 4407 - RNA, 10 nt, Unknown
  source: /note="Description of Unknown: Exemplary gene or splice site sequence"
gggguagggc

SEQ ID NO: 4408 - RNA, 10 nt, Unknown
  source: /note="Description of Unknown: Exemplary gene or splice site sequence"
cuugucagcu

SEQ ID NO: 4409 - RNA, 10 nt, Unknown
  source: /note="Description of Unknown: Exemplary gene or splice site sequence"
cugguauuac

SEQ ID NO: 4410 - RNA, 10 nt, Unknown
  source: /note="Description of Unknown: Exemplary gene or splice site sequence"
uaaguacguc

SEQ ID NO: 4411 - RNA, 10 nt, Unknown
  source: /note="Description of Unknown: Exemplary gene or splice site sequence"
acggugaaag

SEQ ID NO: 4412 - RNA, 10 nt, Unknown
  source: /note="Description of Unknown: Exemplary gene or splice site sequence"
ccagccaaua

SEQ ID NO: 4413 - RNA, 10 nt, Unknown
  source: /note="Description of Unknown: Exemplary gene or splice site sequence"
cagguuuguc

SEQ ID NO: 4414 - RNA, 10 nt, Unknown
  source: /note="Description of Unknown: Exemplary gene or splice site sequence"
aaggucuuag

SEQ ID NO: 4415 - RNA, 10 nt, Unknown
  source: /note="Description of Unknown: Exemplary gene or splice site sequence"
aagguuaggg

SEQ ID NO: 4416 - RNA, 10 nt, Unknown
  source: /note="Description of Unknown: Exemplary gene or splice site sequence"
cggguaaauu

SEQ ID NO: 4417 - RNA, 10 nt, Unknown
  source: /note="Description of Unknown: Exemplary gene or splice site sequence"
cagguaacgg

SEQ ID NO: 4418 - RNA, 10 nt, Unknown
  source: /note="Description of Unknown: Exemplary gene or splice site sequence"
agagugugua

SEQ ID NO: 4419 - RNA, 10 nt, Unknown
  source: /note="Description of Unknown: Exemplary gene or splice site sequence"
gauguaauuu

SEQ ID NO: 4420 - RNA, 10 nt, Unknown
  source: /note="Description of Unknown: Exemplary gene or splice site sequence"
aaagugagga

SEQ ID NO: 4421 - RNA, 10 nt, Unknown
  source: /note="Description of Unknown: Exemplary gene or splice site sequence"
ggaguaaaua

SEQ ID NO: 4422 - RNA, 10 nt, Unknown
  source: /note="Description of Unknown: Exemplary gene or splice site sequence"
gugguaccca

SEQ ID NO: 4423 - RNA, 10 nt, Unknown
  source: /note="Description of Unknown: Exemplary gene or splice site sequence"
cagguauugc

SEQ ID NO: 4424 - RNA, 10 nt, Unknown
  source: /note="Description of Unknown: Exemplary gene or splice site sequence"
gaugugaggg

SEQ ID NO: 4425 - RNA, 10 nt, Unknown
  source: /note="Description of Unknown: Exemplary gene or splice site sequence"
aagguaacag

SEQ ID NO: 4426 - RNA, 10 nt, Unknown
  source: /note="Description of Unknown: Exemplary gene or splice site sequence"
uugguaaaag

SEQ ID NO: 4427 - RNA, 10 nt, Unknown
  source: /note="Description of Unknown: Exemplary gene or splice site sequence"
acggugagac

SEQ ID NO: 4428 - RNA, 10 nt, Unknown
  source: /note="Description of Unknown: Exemplary gene or splice site sequence"
cugguaugac

SEQ ID NO: 4429 - RNA, 10 nt, Unknown
  source: /note="Description of Unknown: Exemplary gene or splice site sequence"
cagguucacu

SEQ ID NO: 4430 - RNA, 10 nt, Unknown
  source: /note="Description of Unknown: Exemplary gene or splice site sequence"
gaggugauca

SEQ ID NO: 4431 - RNA, 10 nt, Unknown
  source: /note="Description of Unknown: Exemplary gene or splice site sequence"
aguguaaguc

SEQ ID NO: 4432 - RNA, 10 nt, Unknown
  source: /note="Description of Unknown: Exemplary gene or splice site sequence"
aacguaagua

SEQ ID NO: 4433 - RNA, 10 nt, Unknown
  source: /note="Description of Unknown: Exemplary gene or splice site sequence"
gagguacagg

SEQ ID NO: 4434 - RNA, 10 nt, Unknown
  source: /note="Description of Unknown: Exemplary gene or splice site sequence"
caaguaauga

SEQ ID NO: 4435 - RNA, 10 nt, Unknown
  source: /note="Description of Unknown: Exemplary gene or splice site sequence"
gauguaagga

SEQ ID NO: 4436 - RNA, 10 nt, Unknown
  source: /note="Description of Unknown: Exemplary gene or splice site sequence"
ucaguucccc

SEQ ID NO: 4437 - RNA, 10 nt, Unknown
  source: /note="Description of Unknown: Exemplary gene or splice site sequence"
gcgguaagga

SEQ ID NO: 4438 - RNA, 10 nt, Unknown
  source: /note="Description of Unknown: Exemplary gene or splice site sequence"
uagguacuaa

SEQ ID NO: 4439 - RNA, 10 nt, Unknown
  source: /note="Description of Unknown: Exemplary gene or splice site sequence"
acuguaagug

SEQ ID NO: 4440 - RNA, 10 nt, Unknown
  source: /note="Description of Unknown: Exemplary gene or splice site sequence"
aaggugugcu

SEQ ID NO: 4441 - RNA, 10 nt, Unknown
  source: /note="Description of Unknown: Exemplary gene or splice site sequence"
aaggugguga

SEQ ID NO: 4442 - RNA, 10 nt, Unknown
  source: /note="Description of Unknown: Exemplary gene or splice site sequence"
acggugcgcc

SEQ ID NO: 4443 - RNA, 10 nt, Unknown
  source: /note="Description of Unknown: Exemplary gene or splice site sequence"
aagguauugc

SEQ ID NO: 4444 - RNA, 10 nt, Unknown
  source: /note="Description of Unknown: Exemplary gene or splice site sequence"
aacgugaaua

SEQ ID NO: 4445 - RNA, 10 nt, Unknown
  source: /note="Description of Unknown: Exemplary gene or splice site sequence"
uagguaugau

SEQ ID NO: 4446 - RNA, 10 nt, Unknown
  source: /note="Description of Unknown: Exemplary gene or splice site sequence"
gggguugguc

SEQ ID NO: 4447 - RNA, 10 nt, Unknown
  source: /note="Description of Unknown: Exemplary gene or splice site sequence"
uaagugaggc

SEQ ID NO: 4448 - RNA, 10 nt, Unknown
  source: /note="Description of Unknown: Exemplary gene or splice site sequence"
caagugaucg

SEQ ID NO: 4449 - RNA, 10 nt, Unknown
  source: /note="Description of Unknown: Exemplary gene or splice site sequence"
aaaguacggg

SEQ ID NO: 4450 - RNA, 10 nt, Unknown
  source: /note="Description of Unknown: Exemplary gene or splice site sequence"
agagcuacag

SEQ ID NO: 4451 - RNA, 10 nt, Unknown
  source: /note="Description of Unknown: Exemplary gene or splice site sequence"
uggguacagc

SEQ ID NO: 4452 - RNA, 10 nt, Unknown
  source: /note="Description of Unknown: Exemplary gene or splice site sequence"
aaggcaagaa

SEQ ID NO: 4453 - RNA, 10 nt, Unknown
  source: /note="Description of Unknown: Exemplary gene or splice site sequence"
gagguaaaca

SEQ ID NO: 4454 - RNA, 10 nt, Unknown
  source: /note="Description of Unknown: Exemplary gene or splice site sequence"
aagguaguca

SEQ ID NO: 4455 - RNA, 10 nt, Unknown
  source: /note="Description of Unknown: Exemplary gene or splice site sequence"
cugguauguc

SEQ ID NO: 4456 - RNA, 10 nt, Unknown
  source: /note="Description of Unknown: Exemplary gene or splice site sequence"
cugguacuga

SEQ ID NO: 4457 - RNA, 10 nt, Unknown
  source: /note="Description of Unknown: Exemplary gene or splice site sequence"
cagguucgug

SEQ ID NO: 4458 - RNA, 10 nt, Unknown
  source: /note="Description of Unknown: Exemplary gene or splice site sequence"
aagguauggu

SEQ ID NO: 4459 - RNA, 10 nt, Unknown
  source: /note="Description of Unknown: Exemplary gene or splice site sequence"
uguguaggug

SEQ ID NO: 4460 - RNA, 10 nt, Unknown
  source: /note="Description of Unknown: Exemplary gene or splice site sequence"
cugguaauau

SEQ ID NO: 4461 - RNA, 10 nt, Unknown
  source: /note="Description of Unknown: Exemplary gene or splice site sequence"
cuagugagaa

SEQ ID NO: 4462 - RNA, 10 nt, Unknown
  source: /note="Description of Unknown: Exemplary gene or splice site sequence"
ucgguaagug

SEQ ID NO: 4463 - RNA, 10 nt, Unknown
  source: /note="Description of Unknown: Exemplary gene or splice site sequence"
gcgguagggc

SEQ ID NO: 4464 - RNA, 10 nt, Unknown
  source: /note="Description of Unknown: Exemplary gene or splice site sequence"
gagguaaucc

SEQ ID NO: 4465 - RNA, 10 nt, Unknown
  source: /note="Description of Unknown: Exemplary gene or splice site sequence"
auuguaauaa

SEQ ID NO: 4466 - RNA, 10 nt, Unknown
  source: /note="Description of Unknown: Exemplary gene or splice site sequence"
aagguuuaaa

SEQ ID NO: 4467 - RNA, 10 nt, Unknown
  source: /note="Description of Unknown: Exemplary gene or splice site sequence"
ccuguacugu

SEQ ID NO: 4468 - RNA, 10 nt, Unknown
  source: /note="Description of Unknown: Exemplary gene or splice site sequence"
gcggugagcg

SEQ ID NO: 4469 - RNA, 10 nt, Unknown
  source: /note="Description of Unknown: Exemplary gene or splice site sequence"
cagguaggcu

SEQ ID NO: 4470 - RNA, 10 nt, Unknown
  source: /note="Description of Unknown: Exemplary gene or splice site sequence"
uagguugguc

SEQ ID NO: 4471 - RNA, 10 nt, Unknown
  source: /note="Description of Unknown: Exemplary gene or splice site sequence"
cagguugccu

SEQ ID NO: 4472 - RNA, 10 nt, Unknown
  source: /note="Description of Unknown: Exemplary gene or splice site sequence"
gguguggacg

SEQ ID NO: 4473 - RNA, 10 nt, Unknown
  source: /note="Description of Unknown: Exemplary gene or splice site sequence"
gauguggcau

SEQ ID NO: 4474 - RNA, 10 nt, Unknown
  source: /note="Description of Unknown: Exemplary gene or splice site sequence"
ucgguaaggu

SEQ ID NO: 4475 - RNA, 10 nt, Unknown
  source: /note="Description of Unknown: Exemplary gene or splice site sequence"
gaggugcguc

SEQ ID NO: 4476 - RNA, 10 nt, Unknown
  source: /note="Description of Unknown: Exemplary gene or splice site sequence"
cgggugaguc

SEQ ID NO: 4477 - RNA, 10 nt, Unknown
  source: /note="Description of Unknown: Exemplary gene or splice site sequence"
gagguucuug

SEQ ID NO: 4478 - RNA, 10 nt, Unknown
  source: /note="Description of Unknown: Exemplary gene or splice site sequence"
aaggugcuug

SEQ ID NO: 4479 - RNA, 10 nt, Unknown
  source: /note="Description of Unknown: Exemplary gene or splice site sequence"
auggucagca

SEQ ID NO: 4480 - RNA, 10 nt, Unknown
  source: /note="Description of Unknown: Exemplary gene or splice site sequence"
cggguacuca

SEQ ID NO: 4481 - RNA, 10 nt, Unknown
  source: /note="Description of Unknown: Exemplary gene or splice site sequence"
aaaguuaauc

SEQ ID NO: 4482 - RNA, 10 nt, Unknown
  source: /note="Description of Unknown: Exemplary gene or splice site sequence"
agcgugagcg

SEQ ID NO: 4483 - RNA, 10 nt, Unknown
  source: /note="Description of Unknown: Exemplary gene or splice site sequence"
ccggcuggug

SEQ ID NO: 4484 - RNA, 10 nt, Unknown
  source: /note="Description of Unknown: Exemplary gene or splice site sequence"
aguguaauuu

SEQ ID NO: 4485 - RNA, 10 nt, Unknown
  source: /note="Description of Unknown: Exemplary gene or splice site sequence"
ugagccacuc

SEQ ID NO: 4486 - RNA, 10 nt, Unknown
  source: /note="Description of Unknown: Exemplary gene or splice site sequence"
ggggucugua

SEQ ID NO: 4487 - RNA, 10 nt, Unknown
  source: /note="Description of Unknown: Exemplary gene or splice site sequence"
auggcauguc

SEQ ID NO: 4488 - RNA, 10 nt, Unknown
  source: /note="Description of Unknown: Exemplary gene or splice site sequence"
cggguaaaga

SEQ ID NO: 4489 - RNA, 10 nt, Unknown
  source: /note="Description of Unknown: Exemplary gene or splice site sequence"
aggguagcau

SEQ ID NO: 4490 - RNA, 10 nt, Unknown
  source: /note="Description of Unknown: Exemplary gene or splice site sequence"
gagguucgug

SEQ ID NO: 4491 - RNA, 10 nt, Unknown
  source: /note="Description of Unknown: Exemplary gene or splice site sequence"
uaaguuauuc

SEQ ID NO: 4492 - RNA, 10 nt, Unknown
  source: /note="Description of Unknown: Exemplary gene or splice site sequence"
caggugguau

SEQ ID NO: 4493 - RNA, 10 nt, Unknown
  source: /note="Description of Unknown: Exemplary gene or splice site sequence"
caggugaagu

SEQ ID NO: 4494 - RNA, 10 nt, Unknown
  source: /note="Description of Unknown: Exemplary gene or splice site sequence"
guaguaauua

SEQ ID NO: 4495 - RNA, 10 nt, Unknown
  source: /note="Description of Unknown: Exemplary gene or splice site sequence"
augguuggug

SEQ ID NO: 4496 - RNA, 10 nt, Unknown
  source: /note="Description of Unknown: Exemplary gene or splice site sequence"
aaggugccuu

SEQ ID NO: 4497 - RNA, 10 nt, Unknown
  source: /note="Description of Unknown: Exemplary gene or splice site sequence"
uccgugaguu

SEQ ID NO: 4498 - RNA, 10 nt, Unknown
  source: /note="Description of Unknown: Exemplary gene or splice site sequence"
aaagcaggua

SEQ ID NO: 4499 - RNA, 10 nt, Unknown
  source: /note="Description of Unknown: Exemplary gene or splice site sequence"
cagguggagg

SEQ ID NO: 4500 - RNA, 10 nt, Unknown
  source: /note="Description of Unknown: Exemplary gene or splice site sequence"
cagguuagac

SEQ ID NO: 4501 - RNA, 10 nt, Unknown
  source: /note="Description of Unknown: Exemplary gene or splice site sequence"
aagguguugu

SEQ ID NO: 4502 - RNA, 10 nt, Unknown
  source: /note="Description of Unknown: Exemplary gene or splice site sequence"
gaggucugug

SEQ ID NO: 4503 - RNA, 10 nt, Unknown
  source: /note="Description of Unknown: Exemplary gene or splice site sequence"
cugguaauua

SEQ ID NO: 4504 - RNA, 10 nt, Unknown
  source: /note="Description of Unknown: Exemplary gene or splice site sequence"
cagguaggcg

SEQ ID NO: 4505 - RNA, 10 nt, Unknown
  source: /note="Description of Unknown: Exemplary gene or splice site sequence"
aauguaggua

SEQ ID NO: 4506 - RNA, 10 nt, Unknown
  source: /note="Description of Unknown: Exemplary gene or splice site sequence"
uagguuagca

SEQ ID NO: 4507 - RNA, 10 nt, Unknown
  source: /note="Description of Unknown: Exemplary gene or splice site sequence"
gagguauugc

SEQ ID NO: 4508 - RNA, 10 nt, Unknown
  source: /note="Description of Unknown: Exemplary gene or splice site sequence"
auuguacaca

SEQ ID NO: 4509 - RNA, 10 nt, Unknown
  source: /note="Description of Unknown: Exemplary gene or splice site sequence"
gaaguaggua

SEQ ID NO: 4510 - RNA, 10 nt, Unknown
  source: /note="Description of Unknown: Exemplary gene or splice site sequence"
ggugugaguu

SEQ ID NO: 4511 - RNA, 10 nt, Unknown
  source: /note="Description of Unknown: Exemplary gene or splice site sequence"
aacgugaguu

SEQ ID NO: 4512 - RNA, 10 nt, Unknown
  source: /note="Description of Unknown: Exemplary gene or splice site sequence"
gagguaaccg

SEQ ID NO: 4513 - RNA, 10 nt, Unknown
  source: /note="Description of Unknown: Exemplary gene or splice site sequence"
auuguaagaa

SEQ ID NO: 4514 - RNA, 10 nt, Unknown
  source: /note="Description of Unknown: Exemplary gene or splice site sequence"
ccaguaucgu

SEQ ID NO: 4515 - RNA, 10 nt, Unknown
  source: /note="Description of Unknown: Exemplary gene or splice site sequence"
ccggugggug

SEQ ID NO: 4516 - RNA, 10 nt, Unknown
  source: /note="Description of Unknown: Exemplary gene or splice site sequence"
gagguagugu

SEQ ID NO: 4517 - RNA, 10 nt, Unknown
  source: /note="Description of Unknown: Exemplary gene or splice site sequence"
acggugggaa

SEQ ID NO: 4518 - RNA, 10 nt, Unknown
  source: /note="Description of Unknown: Exemplary gene or splice site sequence"
cacguaugua

SEQ ID NO: 4519 - RNA, 10 nt, Unknown
  source: /note="Description of Unknown: Exemplary gene or splice site sequence"
gcgguaugac

SEQ ID NO: 4520 - RNA, 10 nt, Unknown
  source: /note="Description of Unknown: Exemplary gene or splice site sequence"
ccgguauuuu

SEQ ID NO: 4521 - RNA, 10 nt, Unknown
  source: /note="Description of Unknown: Exemplary gene or splice site sequence"
gagguagaac

SEQ ID NO: 4522 - RNA, 10 nt, Unknown
  source: /note="Description of Unknown: Exemplary gene or splice site sequence"
caggcgcgug

SEQ ID NO: 4523 - RNA, 10 nt, Unknown
  source: /note="Description of Unknown: Exemplary gene or splice site sequence"
aagguucuac

SEQ ID NO: 4524 - RNA, 10 nt, Unknown
  source: /note="Description of Unknown: Exemplary gene or splice site sequence"
gagguagcag

SEQ ID NO: 4525 - RNA, 10 nt, Unknown
  source: /note="Description of Unknown: Exemplary gene or splice site sequence"
uaagugcugu

SEQ ID NO: 4526 - RNA, 10 nt, Unknown
  source: /note="Description of Unknown: Exemplary gene or splice site sequence"
cucguaaggu

SEQ ID NO: 4527 - RNA, 10 nt, Unknown
  source: /note="Description of Unknown: Exemplary gene or splice site sequence"
caggucagcu

SEQ ID NO: 4528 - RNA, 10 nt, Unknown
  source: /note="Description of Unknown: Exemplary gene or splice site sequence"
agggugcagg

SEQ ID NO: 4529 - RNA, 10 nt, Unknown
  source: /note="Description of Unknown: Exemplary gene or splice site sequence"
gaggugaaac

SEQ ID NO: 4530 - RNA, 10 nt, Unknown
  source: /note="Description of Unknown: Exemplary gene or splice site sequence"
aauguaugcc

SEQ ID NO: 4531 - RNA, 10 nt, Unknown
  source: /note="Description of Unknown: Exemplary gene or splice site sequence"
ucugcucaau

SEQ ID NO: 4532 - RNA, 10 nt, Unknown
  source: /note="Description of Unknown: Exemplary gene or splice site sequence"
acgguaaugu

SEQ ID NO: 4533 - RNA, 10 nt, Unknown
  source: /note="Description of Unknown: Exemplary gene or splice site sequence"
aagguaguug

SEQ ID NO: 4534 - RNA, 10 nt, Unknown
  source: /note="Description of Unknown: Exemplary gene or splice site sequence"
caggugauga

SEQ ID NO: 4535 - RNA, 10 nt, Unknown
  source: /note="Description of Unknown: Exemplary gene or splice site sequence"
gagguaacac

SEQ ID NO: 4536 - RNA, 10 nt, Unknown
  source: /note="Description of Unknown: Exemplary gene or splice site sequence"
agggugugac

SEQ ID NO: 4537 - RNA, 10 nt, Unknown
  source: /note="Description of Unknown: Exemplary gene or splice site sequence"
gaggcaauaa

SEQ ID NO: 4538 - RNA, 10 nt, Unknown
  source: /note="Description of Unknown: Exemplary gene or splice site sequence"
gugguaaagc

SEQ ID NO: 4539 - RNA, 10 nt, Unknown
  source: /note="Description of Unknown: Exemplary gene or splice site sequence"
cuggugggcg

SEQ ID NO: 4540 - RNA, 10 nt, Unknown
  source: /note="Description of Unknown: Exemplary gene or splice site sequence"
ucggucagca

SEQ ID NO: 4541 - RNA, 10 nt, Unknown
  source: /note="Description of Unknown: Exemplary gene or splice site sequence"
auggugauua

SEQ ID NO: 4542 - RNA, 10 nt, Unknown
  source: /note="Description of Unknown: Exemplary gene or splice site sequence"
cgagugugua

SEQ ID NO: 4543 - RNA, 10 nt, Unknown
  source: /note="Description of Unknown: Exemplary gene or splice site sequence"
agcgcaagua

SEQ ID NO: 4544 - RNA, 10 nt, Unknown
  source: /note="Description of Unknown: Exemplary gene or splice site sequence"
uggguacguu

SEQ ID NO: 4545 - RNA, 10 nt, Unknown
  source: /note="Description of Unknown: Exemplary gene or splice site sequence"
aguguacaua

SEQ ID NO: 4546 - RNA, 10 nt, Unknown
  source: /note="Description of Unknown: Exemplary gene or splice site sequence"
acaguagguu

SEQ ID NO: 4547 - RNA, 10 nt, Unknown
  source: /note="Description of Unknown: Exemplary gene or splice site sequence"
uuggugaagu

SEQ ID NO: 4548 - RNA, 10 nt, Unknown
  source: /note="Description of Unknown: Exemplary gene or splice site sequence"
uggguaagga

SEQ ID NO: 4549 - RNA, 10 nt, Unknown
  source: /note="Description of Unknown: Exemplary gene or splice site sequence"
uaggugccuu

SEQ ID NO: 4550 - RNA, 10 nt, Unknown
  source: /note="Description of Unknown: Exemplary gene or splice site sequence"
ccugugggug

SEQ ID NO: 4551 - RNA, 10 nt, Unknown
  source: /note="Description of Unknown: Exemplary gene or splice site sequence"
uccguaaguu

SEQ ID NO: 4552 - RNA, 10 nt, Unknown
  source: /note="Description of Unknown: Exemplary gene or splice site sequence"
gugguaaacg

SEQ ID NO: 4553 - RNA, 10 nt, Unknown
  source: /note="Description of Unknown: Exemplary gene or splice site sequence"
cgggugcggu

SEQ ID NO: 4554 - RNA, 10 nt, Unknown
  source: /note="Description of Unknown: Exemplary gene or splice site sequence"
cauguacuuc

SEQ ID NO: 4555 - RNA, 10 nt, Unknown
  source: /note="Description of Unknown: Exemplary gene or splice site sequence"
agaguaaagg

SEQ ID NO: 4556 - RNA, 10 nt, Unknown
  source: /note="Description of Unknown: Exemplary gene or splice site sequence"
cgcgugagua

SEQ ID NO: 4557 - RNA, 10 nt, Unknown
  source: /note="Description of Unknown: Exemplary gene or splice site sequence"
agagugggca

SEQ ID NO: 4558 - RNA, 10 nt, Unknown
  source: /note="Description of Unknown: Exemplary gene or splice site sequence"
agaguaagcc

SEQ ID NO: 4559 - RNA, 10 nt, Unknown
  source: /note="Description of Unknown: Exemplary gene or splice site sequence"
agaguaaaca

SEQ ID NO: 4560 - RNA, 10 nt, Unknown
  source: /note="Description of Unknown: Exemplary gene or splice site sequence"
gugguuauga

SEQ ID NO: 4561 - RNA, 10 nt, Unknown
  source: /note="Description of Unknown: Exemplary gene or splice site sequence"
aggguaauaa

SEQ ID NO: 4562 - RNA, 10 nt, Unknown
  source: /note="Description of Unknown: Exemplary gene or splice site sequence"
ugaguaagac

SEQ ID NO: 4563 - RNA, 10 nt, Unknown
  source: /note="Description of Unknown: Exemplary gene or splice site sequence"
agaguuuguu

SEQ ID NO: 4564 - RNA, 10 nt, Unknown
  source: /note="Description of Unknown: Exemplary gene or splice site sequence"
cgggucugca

SEQ ID NO: 4565 - RNA, 10 nt, Unknown
  source: /note="Description of Unknown: Exemplary gene or splice site sequence"
cagguaaguc

SEQ ID NO: 4566 - RNA, 10 nt, Unknown
  source: /note="Description of Unknown: Exemplary gene or splice site sequence"
aagguagaau

SEQ ID NO: 4567 - RNA, 10 nt, Unknown
  source: /note="Description of Unknown: Exemplary gene or splice site sequence"
caggucccuc

SEQ ID NO: 4568 - RNA, 10 nt, Unknown
  source: /note="Description of Unknown: Exemplary gene or splice site sequence"
agaguaaugg

SEQ ID NO: 4569 - RNA, 10 nt, Unknown
  source: /note="Description of Unknown: Exemplary gene or splice site sequence"
gaggucuaag

SEQ ID NO: 4570 - RNA, 10 nt, Unknown
  source: /note="Description of Unknown: Exemplary gene or splice site sequence"
agaguagagu

SEQ ID NO: 4571 - RNA, 10 nt, Unknown
  source: /note="Description of Unknown: Exemplary gene or splice site sequence"
auggucagua

SEQ ID NO: 4572 - RNA, 10 nt, Unknown
  source: /note="Description of Unknown: Exemplary gene or splice site sequence"
gaggccuggg

SEQ ID NO: 4573 - RNA, 10 nt, Unknown
  source: /note="Description of Unknown: Exemplary gene or splice site sequence"
aagguguggc

SEQ ID NO: 4574 - RNA, 10 nt, Unknown
  source: /note="Description of Unknown: Exemplary gene or splice site sequence"
agagugaucu

SEQ ID NO: 4575 - RNA, 10 nt, Unknown
  source: /note="Description of Unknown: Exemplary gene or splice site sequence"
aagguaucca

SEQ ID NO: 4576 - RNA, 10 nt, Unknown
  source: /note="Description of Unknown: Exemplary gene or splice site sequence"
uucguaagua

SEQ ID NO: 4577 - RNA, 10 nt, Unknown
  source: /note="Description of Unknown: Exemplary gene or splice site sequence"
uaagugggug

SEQ ID NO: 4578 - RNA, 10 nt, Unknown
  source: /note="Description of Unknown: Exemplary gene or splice site sequence"
gccgugaacg

SEQ ID NO: 4579 - RNA, 10 nt, Unknown
  source: /note="Description of Unknown: Exemplary gene or splice site sequence"
gagguugugg

SEQ ID NO: 4580 - RNA, 10 nt, Unknown
  source: /note="Description of Unknown: Exemplary gene or splice site sequence"
uauguaugca

SEQ ID NO: 4581 - RNA, 10 nt, Unknown
  source: /note="Description of Unknown: Exemplary gene or splice site sequence"
uguguaacaa

SEQ ID NO: 4582 - RNA, 10 nt, Unknown
  source: /note="Description of Unknown: Exemplary gene or splice site sequence"
aggguauuag

SEQ ID NO: 4583 - RNA, 10 nt, Unknown
  source: /note="Description of Unknown: Exemplary gene or splice site sequence"
ugaguauauc

SEQ ID NO: 4584 - RNA, 10 nt, Unknown
  source: /note="Description of Unknown: Exemplary gene or splice site sequence"
agaguuugug

SEQ ID NO: 4585 - RNA, 10 nt, Unknown
  source: /note="Description of Unknown: Exemplary gene or splice site sequence"
gaggucgcug

SEQ ID NO: 4586 - RNA, 10 nt, Unknown
  source: /note="Description of Unknown: Exemplary gene or splice site sequence"
gaggucaucg

SEQ ID NO: 4587 - RNA, 10 nt, Unknown
  source: /note="Description of Unknown: Exemplary gene or splice site sequence"
acgguaaagc

SEQ ID NO: 4588 - RNA, 10 nt, Unknown
  source: /note="Description of Unknown: Exemplary gene or splice site sequence"
ugaguacuug

SEQ ID NO: 4589 - RNA, 10 nt, Unknown
  source: /note="Description of Unknown: Exemplary gene or splice site sequence"
cgagucgccg

SEQ ID NO: 4590 - RNA, 10 nt, Unknown
  source: /note="Description of Unknown: Exemplary gene or splice site sequence"
cugguacguc

SEQ ID NO: 4591 - RNA, 10 nt, Unknown
  source: /note="Description of Unknown: Exemplary gene or splice site sequence"
aggguauugc

SEQ ID NO: 4592 - RNA, 10 nt, Unknown
  source: /note="Description of Unknown: Exemplary gene or splice site sequence"
gaagugaaug

SEQ ID NO: 4593 - RNA, 10 nt, Unknown
  source: /note="Description of Unknown: Exemplary gene or splice site sequence"
cagaugaguc

SEQ ID NO: 4594 - RNA, 10 nt, Unknown
  source: /note="Description of Unknown: Exemplary gene or splice site sequence"
uggguauugg

SEQ ID NO: 4595 - RNA, 10 nt, Unknown
  source: /note="Description of Unknown: Exemplary gene or splice site sequence"
ugaguaaaga

SEQ ID NO: 4596 - RNA, 10 nt, Unknown
  source: /note="Description of Unknown: Exemplary gene or splice site sequence"
gugguuccug

SEQ ID NO: 4597 - RNA, 10 nt, Unknown
  source: /note="Description of Unknown: Exemplary gene or splice site sequence"
ugagcaagua

SEQ ID NO: 4598 - RNA, 10 nt, Unknown
  source: /note="Description of Unknown: Exemplary gene or splice site sequence"
uauguaagag

SEQ ID NO: 4599 - RNA, 10 nt, Unknown
  source: /note="Description of Unknown: Exemplary gene or splice site sequence"
aaggucuugc

SEQ ID NO: 4600 - RNA, 10 nt, Unknown
  source: /note="Description of Unknown: Exemplary gene or splice site sequence"
aaagcaugug

SEQ ID NO: 4601 - RNA, 10 nt, Unknown
  source: /note="Description of Unknown: Exemplary gene or splice site sequence"
agaguacagu

SEQ ID NO: 4602 - RNA, 10 nt, Unknown
  source: /note="Description of Unknown: Exemplary gene or splice site sequence"
gugguaaucc

SEQ ID NO: 4603 - RNA, 10 nt, Unknown
  source: /note="Description of Unknown: Exemplary gene or splice site sequence"
cagguagagg

SEQ ID NO: 4604 - RNA, 10 nt, Unknown
  source: /note="Description of Unknown: Exemplary gene or splice site sequence"
aagguacaac

SEQ ID NO: 4605 - RNA, 10 nt, Unknown
  source: /note="Description of Unknown: Exemplary gene or splice site sequence"
ugggcagcau

SEQ ID NO: 4606 - RNA, 10 nt, Unknown
  source: /note="Description of Unknown: Exemplary gene or splice site sequence"
ccggucauca

SEQ ID NO: 4607 - RNA, 10 nt, Unknown
  source: /note="Description of Unknown: Exemplary gene or splice site sequence"
ccgguuugua

SEQ ID NO: 4608 - RNA, 10 nt, Unknown
  source: /note="Description of Unknown: Exemplary gene or splice site sequence"
ugaguaaggg

SEQ ID NO: 4609 - RNA, 10 nt, Unknown
  source: /note="Description of Unknown: Exemplary gene or splice site sequence"
gaaguaugua

SEQ ID NO: 4610 - RNA, 10 nt, Unknown
  source: /note="Description of Unknown: Exemplary gene or splice site sequence"
gggguagcuc

SEQ ID NO: 4611 - RNA, 10 nt, Unknown
  source: /note="Description of Unknown: Exemplary gene or splice site sequence"
gcuguacaua

SEQ ID NO: 4612 - RNA, 10 nt, Unknown
  source: /note="Description of Unknown: Exemplary gene or splice site sequence"
cuggucucuu

SEQ ID NO: 4613 - RNA, 10 nt, Unknown
  source: /note="Description of Unknown: Exemplary gene or splice site sequence"
gugguaaaug

SEQ ID NO: 4614 - RNA, 10 nt, Unknown
  source: /note="Description of Unknown: Exemplary gene or splice site sequence"
aucguaagug

SEQ ID NO: 4615 - RNA, 10 nt, Unknown
  source: /note="Description of Unknown: Exemplary gene or splice site sequence"
gaggcaugua

SEQ ID NO: 4616 - RNA, 10 nt, Unknown
  source: /note="Description of Unknown: Exemplary gene or splice site sequence"
aaggucuccc

SEQ ID NO: 4617 - RNA, 10 nt, Unknown
  source: /note="Description of Unknown: Exemplary gene or splice site sequence"
ugggugcguu

SEQ ID NO: 4618 - RNA, 10 nt, Unknown
  source: /note="Description of Unknown: Exemplary gene or splice site sequence"
uguguagguu

SEQ ID NO: 4619 - RNA, 10 nt, Unknown
  source: /note="Description of Unknown: Exemplary gene or splice site sequence"
gaagugagca

SEQ ID NO: 4620 - RNA, 10 nt, Unknown
  source: /note="Description of Unknown: Exemplary gene or splice site sequence"
gguguaauuu

SEQ ID NO: 4621 - RNA, 10 nt, Unknown
  source: /note="Description of Unknown: Exemplary gene or splice site sequence"
cuggugaaau

SEQ ID NO: 4622 - RNA, 10 nt, Unknown
  source: /note="Description of Unknown: Exemplary gene or splice site sequence"
aucguaaguc

SEQ ID NO: 4623 - RNA, 10 nt, Unknown
  source: /note="Description of Unknown: Exemplary gene or splice site sequence"
agaguaaucc

SEQ ID NO: 4624 - RNA, 10 nt, Unknown
  source: /note="Description of Unknown: Exemplary gene or splice site sequence"
ggaguagguc

SEQ ID NO: 4625 - RNA, 10 nt, Unknown
  source: /note="Description of Unknown: Exemplary gene or splice site sequence"
gagguaccaa

SEQ ID NO: 4626 - RNA, 10 nt, Unknown
  source: /note="Description of Unknown: Exemplary gene or splice site sequence"
cuuguaggug

SEQ ID NO: 4627 - RNA, 10 nt, Unknown
  source: /note="Description of Unknown: Exemplary gene or splice site sequence"
aagguauaag

SEQ ID NO: 4628 - RNA, 10 nt, Unknown
  source: /note="Description of Unknown: Exemplary gene or splice site sequence"
agaguuggua

SEQ ID NO: 4629 - RNA, 10 nt, Unknown
  source: /note="Description of Unknown: Exemplary gene or splice site sequence"
augguuugug

SEQ ID NO: 4630 - RNA, 10 nt, Unknown
  source: /note="Description of Unknown: Exemplary gene or splice site sequence"
ugggucagau

SEQ ID NO: 4631 - RNA, 10 nt, Unknown
  source: /note="Description of Unknown: Exemplary gene or splice site sequence"
agaguaggac

SEQ ID NO: 4632 - RNA, 10 nt, Unknown
  source: /note="Description of Unknown: Exemplary gene or splice site sequence"
agaguagugu

SEQ ID NO: 4633 - RNA, 10 nt, Unknown
  source: /note="Description of Unknown: Exemplary gene or splice site sequence"
agaguaggag

SEQ ID NO: 4634 - RNA, 10 nt, Unknown
  source: /note="Description of Unknown: Exemplary gene or splice site sequence"
caggucucua

SEQ ID NO: 4635 - RNA, 10 nt, Unknown
  source: /note="Description of Unknown: Exemplary gene or splice site sequence"
aagguggaug

SEQ ID NO: 4636 - RNA, 10 nt, Unknown
  source: /note="Description of Unknown: Exemplary gene or splice site sequence"
uggguaucaa

SEQ ID NO: 4637 - RNA, 10 nt, Unknown
  source: /note="Description of Unknown: Exemplary gene or splice site sequence"
gauguaugga

SEQ ID NO: 4638 - RNA, 10 nt, Unknown
  source: /note="Description of Unknown: Exemplary gene or splice site sequence"
aagguguuuc

SEQ ID NO: 4639 - RNA, 10 nt, Unknown
  source: /note="Description of Unknown: Exemplary gene or splice site sequence"
gcaguguaaa

SEQ ID NO: 4640 - RNA, 10 nt, Unknown
  source: /note="Description of Unknown: Exemplary gene or splice site sequence"
uuaguaugua

SEQ ID NO: 4641 - RNA, 10 nt, Unknown
  source: /note="Description of Unknown: Exemplary gene or splice site sequence"
ucuguaugca

SEQ ID NO: 4642 - RNA, 10 nt, Unknown
  source: /note="Description of Unknown: Exemplary gene or splice site sequence"
aauguaaaau

SEQ ID NO: 4643 - RNA, 10 nt, Unknown
  source: /note="Description of Unknown: Exemplary gene or splice site sequence"
agaguaaauu

SEQ ID NO: 4644 - RNA, 10 nt, Unknown
  source: /note="Description of Unknown: Exemplary gene or splice site sequence"
gggguacuuu

SEQ ID NO: 4645 - RNA, 10 nt, Unknown
  source: /note="Description of Unknown: Exemplary gene or splice site sequence"
gaaguuugau

SEQ ID NO: 4646 - RNA, 10 nt, Unknown
  source: /note="Description of Unknown: Exemplary gene or splice site sequence"
aaaguagauu

SEQ ID NO: 4647 - RNA, 10 nt, Unknown
  source: /note="Description of Unknown: Exemplary gene or splice site sequence"
uguguagagu

SEQ ID NO: 4648 - RNA, 10 nt, Unknown
  source: /note="Description of Unknown: Exemplary gene or splice site sequence"
uggguaagcg

SEQ ID NO: 4649 - RNA, 10 nt, Unknown
  source: /note="Description of Unknown: Exemplary gene or splice site sequence"
cggguucagg

SEQ ID NO: 4650 - RNA, 10 nt, Unknown
  source: /note="Description of Unknown: Exemplary gene or splice site sequence"
aggguacgac

SEQ ID NO: 4651 - RNA, 10 nt, Unknown
  source: /note="Description of Unknown: Exemplary gene or splice site sequence"
ucgguaagaa

SEQ ID NO: 4652 - RNA, 10 nt, Unknown
  source: /note="Description of Unknown: Exemplary gene or splice site sequence"
aggguuggca

SEQ ID NO: 4653 - RNA, 10 nt, Unknown
  source: /note="Description of Unknown: Exemplary gene or splice site sequence"
aaaguacagu

SEQ ID NO: 4654 - RNA, 10 nt, Unknown
  source: /note="Description of Unknown: Exemplary gene or splice site sequence"
uaaguuaagg

SEQ ID NO: 4655 - RNA, 10 nt, Unknown
  source: /note="Description of Unknown: Exemplary gene or splice site sequence"
augguaaugu

SEQ ID NO: 4656 - RNA, 10 nt, Unknown
  source: /note="Description of Unknown: Exemplary gene or splice site sequence"
gugguuuuac

SEQ ID NO: 4657 - RNA, 10 nt, Unknown
  source: /note="Description of Unknown: Exemplary gene or splice site sequence"
agaguaacaa

SEQ ID NO: 4658 - RNA, 10 nt, Unknown
  source: /note="Description of Unknown: Exemplary gene or splice site sequence"
aagguagccc

SEQ ID NO: 4659 - RNA, 10 nt, Unknown
  source: /note="Description of Unknown: Exemplary gene or splice site sequence"
gcggugaggc

SEQ ID NO: 4660 - RNA, 10 nt, Unknown
  source: /note="Description of Unknown: Exemplary gene or splice site sequence"
augguucagc

SEQ ID NO: 4661 - RNA, 10 nt, Unknown
  source: /note="Description of Unknown: Exemplary gene or splice site sequence"
aagguacuua

SEQ ID NO: 4662 - RNA, 10 nt, Unknown
  source: /note="Description of Unknown: Exemplary gene or splice site sequence"
aagguccgug

SEQ ID NO: 4663 - RNA, 10 nt, Unknown
  source: /note="Description of Unknown: Exemplary gene or splice site sequence"
uagguaagcg

SEQ ID NO: 4664 - RNA, 10 nt, Unknown
  source: /note="Description of Unknown: Exemplary gene or splice site sequence"
augguaccuu

SEQ ID NO: 4665 - RNA, 10 nt, Unknown
  source: /note="Description of Unknown: Exemplary gene or splice site sequence"
gccguggugg

SEQ ID NO: 4666 - RNA, 10 nt, Unknown
  source: /note="Description of Unknown: Exemplary gene or splice site sequence"
cuggugcguc

SEQ ID NO: 4667 - RNA, 10 nt, Unknown
  source: /note="Description of Unknown: Exemplary gene or splice site sequence"
cagguggaaa

SEQ ID NO: 4668 - RNA, 10 nt, Unknown
  source: /note="Description of Unknown: Exemplary gene or splice site sequence"
aaagucugua

SEQ ID NO: 4669 - RNA, 10 nt, Unknown
  source: /note="Description of Unknown: Exemplary gene or splice site sequence"
gagguaaccc

SEQ ID NO: 4670 - RNA, 10 nt, Unknown
  source: /note="Description of Unknown: Exemplary gene or splice site sequence"
agaguauggg

SEQ ID NO: 4671 - RNA, 10 nt, Unknown
  source: /note="Description of Unknown: Exemplary gene or splice site sequence"
uaugccccug

SEQ ID NO: 4672 - RNA, 10 nt, Unknown
  source: /note="Description of Unknown: Exemplary gene or splice site sequence"
aaggugccag

SEQ ID NO: 4673 - RNA, 10 nt, Unknown
  source: /note="Description of Unknown: Exemplary gene or splice site sequence"
acggugcggc

SEQ ID NO: 4674 - RNA, 10 nt, Unknown
  source: /note="Description of Unknown: Exemplary gene or splice site sequence"
aggguacuga

SEQ ID NO: 4675 - RNA, 10 nt, Unknown
  source: /note="Description of Unknown: Exemplary gene or splice site sequence"
agaguaagcg

SEQ ID NO: 4676 - RNA, 10 nt, Unknown
  source: /note="Description of Unknown: Exemplary gene or splice site sequence"
cuggcaaggg

SEQ ID NO: 4677 - RNA, 10 nt, Unknown
  source: /note="Description of Unknown: Exemplary gene or splice site sequence"
ccagugugug

SEQ ID NO: 4678 - RNA, 10 nt, Unknown
  source: /note="Description of Unknown: Exemplary gene or splice site sequence"
gagguagacg

SEQ ID NO: 4679 - RNA, 10 nt, Unknown
  source: /note="Description of Unknown: Exemplary gene or splice site sequence"
cgggugcggg

SEQ ID NO: 4680 - RNA, 10 nt, Unknown
  source: /note="Description of Unknown: Exemplary gene or splice site sequence"
gauguaagcu

SEQ ID NO: 4681 - RNA, 10 nt, Unknown
  source: /note="Description of Unknown: Exemplary gene or splice site sequence"
auuguauuua

SEQ ID NO: 4682 - RNA, 10 nt, Unknown
  source: /note="Description of Unknown: Exemplary gene or splice site sequence"
ugcgugagug

SEQ ID NO: 4683 - RNA, 10 nt, Unknown
  source: /note="Description of Unknown: Exemplary gene or splice site sequence"
cuggucuaua

SEQ ID NO: 4684 - RNA, 10 nt, Unknown
  source: /note="Description of Unknown: Exemplary gene or splice site sequence"
gaggugcuag

SEQ ID NO: 4685 - RNA, 10 nt, Unknown
  source: /note="Description of Unknown: Exemplary gene or splice site sequence"
gaggugccau

SEQ ID NO: 4686 - RNA, 10 nt, Unknown
  source: /note="Description of Unknown: Exemplary gene or splice site sequence"
cagguacguc

SEQ ID NO: 4687 - RNA, 10 nt, Unknown
  source: /note="Description of Unknown: Exemplary gene or splice site sequence"
gagguucagc

SEQ ID NO: 4688 - RNA, 10 nt, Unknown
  source: /note="Description of Unknown: Exemplary gene or splice site sequence"
aacguaagaa

SEQ ID NO: 4689 - RNA, 10 nt, Unknown
  source: /note="Description of Unknown: Exemplary gene or splice site sequence"
agaguaguac

SEQ ID NO: 4690 - RNA, 10 nt, Unknown
  source: /note="Description of Unknown: Exemplary gene or splice site sequence"
aagguaacgg

SEQ ID NO: 4691 - RNA, 10 nt, Unknown
  source: /note="Description of Unknown: Exemplary gene or splice site sequence"
uaggugugac

SEQ ID NO: 4692 - RNA, 10 nt, Unknown
  source: /note="Description of Unknown: Exemplary gene or splice site sequence"
ccgguaauag

SEQ ID NO: 4693 - RNA, 10 nt, Unknown
  source: /note="Description of Unknown: Exemplary gene or splice site sequence"
cagguaccag

SEQ ID NO: 4694 - RNA, 10 nt, Unknown
  source: /note="Description of Unknown: Exemplary gene or splice site sequence"
uuuguaauug

SEQ ID NO: 4695 - RNA, 10 nt, Unknown
  source: /note="Description of Unknown: Exemplary gene or splice site sequence"
aauguacgaa

SEQ ID NO: 4696 - RNA, 10 nt, Unknown
  source: /note="Description of Unknown: Exemplary gene or splice site sequence"
cagguaauga

SEQ ID NO: 4697 - RNA, 10 nt, Unknown
  source: /note="Description of Unknown: Exemplary gene or splice site sequence"
aucgucaagg

SEQ ID NO: 4698 - RNA, 10 nt, Unknown
  source: /note="Description of Unknown: Exemplary gene or splice site sequence"
cugguagaug

SEQ ID NO: 4699 - RNA, 10 nt, Unknown
  source: /note="Description of Unknown: Exemplary gene or splice site sequence"
ggggugcagu

SEQ ID NO: 4700 - RNA, 10 nt, Unknown
  source: /note="Description of Unknown: Exemplary gene or splice site sequence"
agugugagaa

SEQ ID NO: 4701 - RNA, 10 nt, Unknown
  source: /note="Description of Unknown: Exemplary gene or splice site sequence"
gggguuuuau

SEQ ID NO: 4702 - RNA, 10 nt, Unknown
  source: /note="Description of Unknown: Exemplary gene or splice site sequence"
ccuguccccu

SEQ ID NO: 4703 - RNA, 10 nt, Unknown
  source: /note="Description of Unknown: Exemplary gene or splice site sequence"
auugugaagu

SEQ ID NO: 4704 - RNA, 10 nt, Unknown
  source: /note="Description of Unknown: Exemplary gene or splice site sequence"
aagguaaacg

SEQ ID NO: 4705 - RNA, 10 nt, Unknown
  source: /note="Description of Unknown: Exemplary gene or splice site sequence"
uacgucgugg

SEQ ID NO: 4706 - RNA, 10 nt, Unknown
  source: /note="Description of Unknown: Exemplary gene or splice site sequence"
aaggugccau

SEQ ID NO: 4707 - RNA, 10 nt, Unknown
  source: /note="Description of Unknown: Exemplary gene or splice site sequence"
ggggucccag

SEQ ID NO: 4708 - RNA, 10 nt, Unknown
  source: /note="Description of Unknown: Exemplary gene or splice site sequence"
uauguauggu

SEQ ID NO: 4709 - RNA, 10 nt, Unknown
  source: /note="Description of Unknown: Exemplary gene or splice site sequence"
cggguaauua

SEQ ID NO: 4710 - RNA, 10 nt, Unknown
  source: /note="Description of Unknown: Exemplary gene or splice site sequence"
cggguacucc

SEQ ID NO: 4711 - RNA, 10 nt, Unknown
  source: /note="Description of Unknown: Exemplary gene or splice site sequence"
caggugacuu

SEQ ID NO: 4712 - RNA, 10 nt, Unknown
  source: /note="Description of Unknown: Exemplary gene or splice site sequence"
aguguggguu

SEQ ID NO: 4713 - RNA, 10 nt, Unknown
  source: /note="Description of Unknown: Exemplary gene or splice site sequence"
agaguauggc

SEQ ID NO: 4714 - RNA, 10 nt, Unknown
  source: /note="Description of Unknown: Exemplary gene or splice site sequence"
aaggccaaca

SEQ ID NO: 4715 - RNA, 10 nt, Unknown
  source: /note="Description of Unknown: Exemplary gene or splice site sequence"
aaagcaagua

SEQ ID NO: 4716 - RNA, 10 nt, Unknown
  source: /note="Description of Unknown: Exemplary gene or splice site sequence"
ucaguagguc

SEQ ID NO: 4717 - RNA, 10 nt, Unknown
  source: /note="Description of Unknown: Exemplary gene or splice site sequence"
gugguggcgg

SEQ ID NO: 4718 - RNA, 10 nt, Unknown
  source: /note="Description of Unknown: Exemplary gene or splice site sequence"
cauguauccu

SEQ ID NO: 4719 - RNA, 10 nt, Unknown
  source: /note="Description of Unknown: Exemplary gene or splice site sequence"
ucggugagcc

SEQ ID NO: 4720 - RNA, 10 nt, Unknown
  source: /note="Description of Unknown: Exemplary gene or splice site sequence"
auaguugggu

SEQ ID NO: 4721 - RNA, 10 nt, Unknown
  source: /note="Description of Unknown: Exemplary gene or splice site sequence"
aauguuagcu

SEQ ID NO: 4722 - RNA, 10 nt, Unknown
  source: /note="Description of Unknown: Exemplary gene or splice site sequence"
auggugaaug

SEQ ID NO: 4723 - RNA, 10 nt, Unknown
  source: /note="Description of Unknown: Exemplary gene or splice site sequence"
cggguaaugu

SEQ ID NO: 4724 - RNA, 10 nt, Unknown
  source: /note="Description of Unknown: Exemplary gene or splice site sequence"
ucuguaggug

SEQ ID NO: 4725 - RNA, 10 nt, Unknown
  source: /note="Description of Unknown: Exemplary gene or splice site sequence"
ccggugaggc

SEQ ID NO: 4726 - RNA, 10 nt, Unknown
  source: /note="Description of Unknown: Exemplary gene or splice site sequence"
ugaguccacu

SEQ ID NO: 4727 - RNA, 10 nt, Unknown
  source: /note="Description of Unknown: Exemplary gene or splice site sequence"
cuaguaagag

SEQ ID NO: 4728 - RNA, 10 nt, Unknown
  source: /note="Description of Unknown: Exemplary gene or splice site sequence"
cggguggggc

SEQ ID NO: 4729 - RNA, 10 nt, Unknown
  source: /note="Description of Unknown: Exemplary gene or splice site sequence"
cgaguaagca

SEQ ID NO: 4730 - RNA, 10 nt, Unknown
  source: /note="Description of Unknown: Exemplary gene or splice site sequence"
ugugccaauu

SEQ ID NO: 4731 - RNA, 10 nt, Unknown
  source: /note="Description of Unknown: Exemplary gene or splice site sequence"
ucgguaagcc

SEQ ID NO: 4732 - RNA, 10 nt, Unknown
  source: /note="Description of Unknown: Exemplary gene or splice site sequence"
uauguaggug

SEQ ID NO: 4733 - RNA, 10 nt, Unknown
  source: /note="Description of Unknown: Exemplary gene or splice site sequence"
uuggugggcc

SEQ ID NO: 4734 - RNA, 10 nt, Unknown
  source: /note="Description of Unknown: Exemplary gene or splice site sequence"
gaggcugggc

SEQ ID NO: 4735 - RNA, 10 nt, Unknown
  source: /note="Description of Unknown: Exemplary gene or splice site sequence"
agaguaacuu

SEQ ID NO: 4736 - RNA, 10 nt, Unknown
  source: /note="Description of Unknown: Exemplary gene or splice site sequence"
acgguagguc

SEQ ID NO: 4737 - RNA, 10 nt, Unknown
  source: /note="Description of Unknown: Exemplary gene or splice site sequence"
caggcccaga

SEQ ID NO: 4738 - RNA, 10 nt, Unknown
  source: /note="Description of Unknown: Exemplary gene or splice site sequence"
ccgguggguu

SEQ ID NO: 4739 - RNA, 10 nt, Unknown
  source: /note="Description of Unknown: Exemplary gene or splice site sequence"
aaggugacgg

SEQ ID NO: 4740 - RNA, 10 nt, Unknown
  source: /note="Description of Unknown: Exemplary gene or splice site sequence"
gggguacagc

SEQ ID NO: 4741 - RNA, 10 nt, Unknown
  source: /note="Description of Unknown: Exemplary gene or splice site sequence"
cauguaaguc

SEQ ID NO: 4742 - RNA, 10 nt, Unknown
  source: /note="Description of Unknown: Exemplary gene or splice site sequence"
auugugagaa

SEQ ID NO: 4743 - RNA, 10 nt, Unknown
  source: /note="Description of Unknown: Exemplary gene or splice site sequence"
uguguaagga

SEQ ID NO: 4744 - RNA, 10 nt, Unknown
  source: /note="Description of Unknown: Exemplary gene or splice site sequence"
uuuguaagau

SEQ ID NO: 4745 - RNA, 10 nt, Unknown
  source: /note="Description of Unknown: Exemplary gene or splice site sequence"
agggucauuu

SEQ ID NO: 4746 - RNA, 10 nt, Unknown
  source: /note="Description of Unknown: Exemplary gene or splice site sequence"
uggguuuguu

SEQ ID NO: 4747 - RNA, 10 nt, Unknown
  source: /note="Description of Unknown: Exemplary gene or splice site sequence"
cgaguaagcc

SEQ ID NO: 4748 - RNA, 10 nt, Unknown
  source: /note="Description of Unknown: Exemplary gene or splice site sequence"
guggugugua

SEQ ID NO: 4749 - RNA, 10 nt, Unknown
  source: /note="Description of Unknown: Exemplary gene or splice site sequence"
augguauaac

SEQ ID NO: 4750 - RNA, 10 nt, Unknown
  source: /note="Description of Unknown: Exemplary gene or splice site sequence"
uggguacgua

SEQ ID NO: 4751 - RNA, 10 nt, Unknown
  source: /note="Description of Unknown: Exemplary gene or splice site sequence"
aaaguagagu

SEQ ID NO: 4752 - RNA, 10 nt, Unknown
  source: /note="Description of Unknown: Exemplary gene or splice site sequence"
ucgguaacug

SEQ ID NO: 4753 - RNA, 10 nt, Unknown
  source: /note="Description of Unknown: Exemplary gene or splice site sequence"
agaguaauga

SEQ ID NO: 4754 - RNA, 10 nt, Unknown
  source: /note="Description of Unknown: Exemplary gene or splice site sequence"
augguggguc

SEQ ID NO: 4755 - RNA, 10 nt, Unknown
  source: /note="Description of Unknown: Exemplary gene or splice site sequence"
agaguaauau

SEQ ID NO: 4756 - RNA, 10 nt, Unknown
  source: /note="Description of Unknown: Exemplary gene or splice site sequence"
cagguacugg

SEQ ID NO: 4757 - RNA, 10 nt, Unknown
  source: /note="Description of Unknown: Exemplary gene or splice site sequence"
uaagucaguu

SEQ ID NO: 4758 - RNA, 10 nt, Unknown
  source: /note="Description of Unknown: Exemplary gene or splice site sequence"
gcgguagaga

SEQ ID NO: 4759 - RNA, 10 nt, Unknown
  source: /note="Description of Unknown: Exemplary gene or splice site sequence"
aaggugaugg

SEQ ID NO: 4760 - RNA, 10 nt, Unknown
  source: /note="Description of Unknown: Exemplary gene or splice site sequence"
acaguauguu

SEQ ID NO: 4761 - RNA, 10 nt, Unknown
  source: /note="Description of Unknown: Exemplary gene or splice site sequence"
gauguacguc

SEQ ID NO: 4762 - RNA, 10 nt, Unknown
  source: /note="Description of Unknown: Exemplary gene or splice site sequence"
uagguuucuc

SEQ ID NO: 4763 - RNA, 10 nt, Unknown
  source: /note="Description of Unknown: Exemplary gene or splice site sequence"
gaggcauggg

SEQ ID NO: 4764 - RNA, 10 nt, Unknown
  source: /note="Description of Unknown: Exemplary gene or splice site sequence"
auagcuaagu

SEQ ID NO: 4765 - RNA, 10 nt, Unknown
  source: /note="Description of Unknown: Exemplary gene or splice site sequence"
guagucugua

SEQ ID NO: 4766 - RNA, 10 nt, Unknown
  source: /note="Description of Unknown: Exemplary gene or splice site sequence"
aaggugaacg

SEQ ID NO: 4767 - RNA, 10 nt, Unknown
  source: /note="Description of Unknown: Exemplary gene or splice site sequence"
gugguggucg

SEQ ID NO: 4768 - RNA, 10 nt, Unknown
  source: /note="Description of Unknown: Exemplary gene or splice site sequence"
gagguugauc

SEQ ID NO: 4769 - RNA, 10 nt, Unknown
  source: /note="Description of Unknown: Exemplary gene or splice site sequence"
ugaguggguu

SEQ ID NO: 4770 - RNA, 10 nt, Unknown
  source: /note="Description of Unknown: Exemplary gene or splice site sequence"
acuguacgug

SEQ ID NO: 4771 - RNA, 10 nt, Unknown
  source: /note="Description of Unknown: Exemplary gene or splice site sequence"
cuggugacug

SEQ ID NO: 4772 - RNA, 10 nt, Unknown
  source: /note="Description of Unknown: Exemplary gene or splice site sequence"
caaguuaagc

SEQ ID NO: 4773 - RNA, 10 nt, Unknown
  source: /note="Description of Unknown: Exemplary gene or splice site sequence"
gagguaccca

SEQ ID NO: 4774 - RNA, 10 nt, Unknown
  source: /note="Description of Unknown: Exemplary gene or splice site sequence"
aacguaacuu

SEQ ID NO: 4775 - RNA, 10 nt, Unknown
  source: /note="Description of Unknown: Exemplary gene or splice site sequence"
cagguuacua

SEQ ID NO: 4776 - RNA, 10 nt, Unknown
  source: /note="Description of Unknown: Exemplary gene or splice site sequence"
agaguuaguc

SEQ ID NO: 4777 - RNA, 10 nt, Unknown
  source: /note="Description of Unknown: Exemplary gene or splice site sequence"
ugggcacguc

SEQ ID NO: 4778 - RNA, 10 nt, Unknown
  source: /note="Description of Unknown: Exemplary gene or splice site sequence"
aguguauggu

SEQ ID NO: 4779 - RNA, 10 nt, Unknown
  source: /note="Description of Unknown: Exemplary gene or splice site sequence"
aagguugcaa

SEQ ID NO: 4780 - RNA, 10 nt, Unknown
  source: /note="Description of Unknown: Exemplary gene or splice site sequence"
cagguuguua

SEQ ID NO: 4781 - RNA, 10 nt, Unknown
  source: /note="Description of Unknown: Exemplary gene or splice site sequence"
aaggcauccc

SEQ ID NO: 4782 - RNA, 10 nt, Unknown
  source: /note="Description of Unknown: Exemplary gene or splice site sequence"
gauguaaggc

SEQ ID NO: 4783 - RNA, 10 nt, Unknown
  source: /note="Description of Unknown: Exemplary gene or splice site sequence"
aggguacggg

SEQ ID NO: 4784 - RNA, 10 nt, Unknown
  source: /note="Description of Unknown: Exemplary gene or splice site sequence"
gaggucaaag

SEQ ID NO: 4785 - RNA, 10 nt, Unknown
  source: /note="Description of Unknown: Exemplary gene or splice site sequence"
caagugagcg

SEQ ID NO: 4786 - RNA, 10 nt, Unknown
  source: /note="Description of Unknown: Exemplary gene or splice site sequence"
agaguaaucu

SEQ ID NO: 4787 - RNA, 10 nt, Unknown
  source: /note="Description of Unknown: Exemplary gene or splice site sequence"
ucgguagcug

SEQ ID NO: 4788 - RNA, 10 nt, Unknown
  source: /note="Description of Unknown: Exemplary gene or splice site sequence"
aaaguaguag

SEQ ID NO: 4789 - RNA, 10 nt, Unknown
  source: /note="Description of Unknown: Exemplary gene or splice site sequence"
cagguucguc

SEQ ID NO: 4790 - RNA, 10 nt, Unknown
  source: /note="Description of Unknown: Exemplary gene or splice site sequence"
cguguaugaa

SEQ ID NO: 4791 - RNA, 10 nt, Unknown
  source: /note="Description of Unknown: Exemplary gene or splice site sequence"
aguguaaaaa

SEQ ID NO: 4792 - RNA, 10 nt, Unknown
  source: /note="Description of Unknown: Exemplary gene or splice site sequence"
aaggucucac

SEQ ID NO: 4793 - RNA, 10 nt, Unknown
  source: /note="Description of Unknown: Exemplary gene or splice site sequence"
uagguggagc

SEQ ID NO: 4794 - RNA, 10 nt, Unknown
  source: /note="Description of Unknown: Exemplary gene or splice site sequence"
ugaguaggug

SEQ ID NO: 4795 - RNA, 10 nt, Unknown
  source: /note="Description of Unknown: Exemplary gene or splice site sequence"
agaguaugcc

SEQ ID NO: 4796 - RNA, 10 nt, Unknown
  source: /note="Description of Unknown: Exemplary gene or splice site sequence"
gagguugcau

SEQ ID NO: 4797 - RNA, 10 nt, Unknown
  source: /note="Description of Unknown: Exemplary gene or splice site sequence"
caaguaagag

SEQ ID NO: 4798 - RNA, 10 nt, Unknown
  source: /note="Description of Unknown: Exemplary gene or splice site sequence"
ucugugugcc

SEQ ID NO: 4799 - RNA, 10 nt, Unknown
  source: /note="Description of Unknown: Exemplary gene or splice site sequence"
gaggugaugc

SEQ ID NO: 4800 - RNA, 10 nt, Unknown
  source: /note="Description of Unknown: Exemplary gene or splice site sequence"
ggggugauaa

SEQ ID NO: 4801 - RNA, 10 nt, Unknown
  source: /note="Description of Unknown: Exemplary gene or splice site sequence"
cccgugagcc

SEQ ID NO: 4802 - RNA, 10 nt, Unknown
  source: /note="Description of Unknown: Exemplary gene or splice site sequence"
agaguaacug

SEQ ID NO: 4803 - RNA, 10 nt, Unknown
  source: /note="Description of Unknown: Exemplary gene or splice site sequence"
gcgguaagua

SEQ ID NO: 4804 - RNA, 10 nt, Unknown
  source: /note="Description of Unknown: Exemplary gene or splice site sequence"
agaguacauc

SEQ ID NO: 4805 - RNA, 10 nt, Unknown
  source: /note="Description of Unknown: Exemplary gene or splice site sequence"
ucggucuggg

SEQ ID NO: 4806 - RNA, 10 nt, Unknown
  source: /note="Description of Unknown: Exemplary gene or splice site sequence"
uaaguaucuc

SEQ ID NO: 4807 - RNA, 10 nt, Unknown
  source: /note="Description of Unknown: Exemplary gene or splice site sequence"
ggcguagguu

SEQ ID NO: 4808 - RNA, 10 nt, Unknown
  source: /note="Description of Unknown: Exemplary gene or splice site sequence"
agaguacgcc

SEQ ID NO: 4809 - RNA, 10 nt, Unknown
  source: /note="Description of Unknown: Exemplary gene or splice site sequence"
gaugucuucu

SEQ ID NO: 4810 - RNA, 10 nt, Unknown
  source: /note="Description of Unknown: Exemplary gene or splice site sequence"
agggcaaggu

SEQ ID NO: 4811 - RNA, 10 nt, Unknown
  source: /note="Description of Unknown: Exemplary gene or splice site sequence"
cgaguaugau

SEQ ID NO: 4812 - RNA, 10 nt, Unknown
  source: /note="Description of Unknown: Exemplary gene or splice site sequence"
augguagagu

SEQ ID NO: 4813 - RNA, 10 nt, Unknown
  source: /note="Description of Unknown: Exemplary gene or splice site sequence"
caaguacgag

SEQ ID NO: 4814 - RNA, 10 nt, Unknown
  source: /note="Description of Unknown: Exemplary gene or splice site sequence"
ucgguaugau

SEQ ID NO: 4815 - RNA, 10 nt, Unknown
  source: /note="Description of Unknown: Exemplary gene or splice site sequence"
ccgguguguu

SEQ ID NO: 4816 - RNA, 10 nt, Unknown
  source: /note="Description of Unknown: Exemplary gene or splice site sequence"
agggucugug

SEQ ID NO: 4817 - RNA, 10 nt, Unknown
  source: /note="Description of Unknown: Exemplary gene or splice site sequence"
ggaguaggcu

SEQ ID NO: 4818 - RNA, 10 nt, Unknown
  source: /note="Description of Unknown: Exemplary gene or splice site sequence"
aaggucuaug

SEQ ID NO: 4819 - RNA, 10 nt, Unknown
  source: /note="Description of Unknown: Exemplary gene or splice site sequence"
gcagugcgug

SEQ ID NO: 4820 - RNA, 10 nt, Unknown
  source: /note="Description of Unknown: Exemplary gene or splice site sequence"
ugggugagaa

SEQ ID NO: 4821 - RNA, 10 nt, Unknown
  source: /note="Description of Unknown: Exemplary gene or splice site sequence"
aggguaaagu

SEQ ID NO: 4822 - RNA, 10 nt, Unknown
  source: /note="Description of Unknown: Exemplary gene or splice site sequence"
gagguaggac

SEQ ID NO: 4823 - RNA, 10 nt, Unknown
  source: /note="Description of Unknown: Exemplary gene or splice site sequence"
cuaguaagca

SEQ ID NO: 4824 - RNA, 10 nt, Unknown
  source: /note="Description of Unknown: Exemplary gene or splice site sequence"
uuaguaggcu

SEQ ID NO: 4825 - RNA, 10 nt, Unknown
  source: /note="Description of Unknown: Exemplary gene or splice site sequence"
cuggugggau

SEQ ID NO: 4826 - RNA, 10 nt, Unknown
  source: /note="Description of Unknown: Exemplary gene or splice site sequence"
cugguuagua

SEQ ID NO: 4827 - RNA, 10 nt, Unknown
  source: /note="Description of Unknown: Exemplary gene or splice site sequence"
aagguacgug

SEQ ID NO: 4828 - RNA, 10 nt, Unknown
  source: /note="Description of Unknown: Exemplary gene or splice site sequence"
cgggugagau

SEQ ID NO: 4829 - RNA, 10 nt, Unknown
  source: /note="Description of Unknown: Exemplary gene or splice site sequence"
aaggugcaug

SEQ ID NO: 4830 - RNA, 10 nt, Unknown
  source: /note="Description of Unknown: Exemplary gene or splice site sequence"
aaugugggcu

SEQ ID NO: 4831 - RNA, 10 nt, Unknown
  source: /note="Description of Unknown: Exemplary gene or splice site sequence"
cagguugacu

SEQ ID NO: 4832 - RNA, 10 nt, Unknown
  source: /note="Description of Unknown: Exemplary gene or splice site sequence"
cagguuacag

SEQ ID NO: 4833 - RNA, 10 nt, Unknown
  source: /note="Description of Unknown: Exemplary gene or splice site sequence"
gcgguaacau

SEQ ID NO: 4834 - RNA, 10 nt, Unknown
  source: /note="Description of Unknown: Exemplary gene or splice site sequence"
auugucaguc

SEQ ID NO: 4835 - RNA, 10 nt, Unknown
  source: /note="Description of Unknown: Exemplary gene or splice site sequence"
caaguauaca

SEQ ID NO: 4836 - RNA, 10 nt, Unknown
  source: /note="Description of Unknown: Exemplary gene or splice site sequence"
gauguccgcc

SEQ ID NO: 4837 - RNA, 10 nt, Unknown
  source: /note="Description of Unknown: Exemplary gene or splice site sequence"
aaggugcgga

SEQ ID NO: 4838 - RNA, 10 nt, Unknown
  source: /note="Description of Unknown: Exemplary gene or splice site sequence"
aacguaagag

SEQ ID NO: 4839 - RNA, 10 nt, Unknown
  source: /note="Description of Unknown: Exemplary gene or splice site sequence"
uggguuggua

SEQ ID NO: 4840 - RNA, 10 nt, Unknown
  source: /note="Description of Unknown: Exemplary gene or splice site sequence"
caaguguaag

SEQ ID NO: 4841 - RNA, 10 nt, Unknown
  source: /note="Description of Unknown: Exemplary gene or splice site sequence"
gugguaacgu

SEQ ID NO: 4842 - RNA, 10 nt, Unknown
  source: /note="Description of Unknown: Exemplary gene or splice site sequence"
cuggugauca

SEQ ID NO: 4843 - RNA, 10 nt, Unknown
  source: /note="Description of Unknown: Exemplary gene or splice site sequence"
aggguggggc

SEQ ID NO: 4844 - RNA, 10 nt, Unknown
  source: /note="Description of Unknown: Exemplary gene or splice site sequence"
ucgguaaaga

SEQ ID NO: 4845 - RNA, 10 nt, Unknown
  source: /note="Description of Unknown: Exemplary gene or splice site sequence"
cagguacacc

SEQ ID NO: 4846 - RNA, 10 nt, Unknown
  source: /note="Description of Unknown: Exemplary gene or splice site sequence"
cggguaaggg

SEQ ID NO: 4847 - RNA, 10 nt, Unknown
  source: /note="Description of Unknown: Exemplary gene or splice site sequence"
caaguuugcu

SEQ ID NO: 4848 - RNA, 10 nt, Unknown
  source: /note="Description of Unknown: Exemplary gene or splice site sequence"
acagugcgug

SEQ ID NO: 4849 - RNA, 10 nt, Unknown
  source: /note="Description of Unknown: Exemplary gene or splice site sequence"
uugguauggg

SEQ ID NO: 4850 - RNA, 10 nt, Unknown
  source: /note="Description of Unknown: Exemplary gene or splice site sequence"
gaggcucauc

SEQ ID NO: 4851 - RNA, 10 nt, Unknown
  source: /note="Description of Unknown: Exemplary gene or splice site sequence"
cugguaauag

SEQ ID NO: 4852 - RNA, 10 nt, Unknown
  source: /note="Description of Unknown: Exemplary gene or splice site sequence"
augguggaua

SEQ ID NO: 4853 - RNA, 10 nt, Unknown
  source: /note="Description of Unknown: Exemplary gene or splice site sequence"
ucagugaauu

SEQ ID NO: 4854 - RNA, 10 nt, Unknown
  source: /note="Description of Unknown: Exemplary gene or splice site sequence"
aauguaauua

SEQ ID NO: 4855 - RNA, 10 nt, Unknown
  source: /note="Description of Unknown: Exemplary gene or splice site sequence"
gcagucuaaa

SEQ ID NO: 4856 - RNA, 10 nt, Unknown
  source: /note="Description of Unknown: Exemplary gene or splice site sequence"
aagguauucu

SEQ ID NO: 4857 - RNA, 10 nt, Unknown
  source: /note="Description of Unknown: Exemplary gene or splice site sequence"
gaggucauca

SEQ ID NO: 4858 - RNA, 10 nt, Unknown
  source: /note="Description of Unknown: Exemplary gene or splice site sequence"
uggguccaug

SEQ ID NO: 4859 - RNA, 10 nt, Unknown
  source: /note="Description of Unknown: Exemplary gene or splice site sequence"
agaguuugua

SEQ ID NO: 4860 - RNA, 10 nt, Unknown
  source: /note="Description of Unknown: Exemplary gene or splice site sequence"
aggguagacu

SEQ ID NO: 4861 - RNA, 10 nt, Unknown
  source: /note="Description of Unknown: Exemplary gene or splice site sequence"
aagguaggac

SEQ ID NO: 4862 - RNA, 10 nt, Unknown
  source: /note="Description of Unknown: Exemplary gene or splice site sequence"
uguguguuga

SEQ ID NO: 4863 - RNA, 10 nt, Unknown
  source: /note="Description of Unknown: Exemplary gene or splice site sequence"
ucaguacgug

SEQ ID NO: 4864 - RNA, 10 nt, Unknown
  source: /note="Description of Unknown: Exemplary gene or splice site sequence"
auggucucuc

SEQ ID NO: 4865 - RNA, 10 nt, Unknown
  source: /note="Description of Unknown: Exemplary gene or splice site sequence"
ugaguuagua

SEQ ID NO: 4866 - RNA, 10 nt, Unknown
  source: /note="Description of Unknown: Exemplary gene or splice site sequence"
ugaguaaagu

SEQ ID NO: 4867 - RNA, 10 nt, Unknown
  source: /note="Description of Unknown: Exemplary gene or splice site sequence"
gaggugaccg

SEQ ID NO: 4868 - RNA, 10 nt, Unknown
  source: /note="Description of Unknown: Exemplary gene or splice site sequence"
gagguauauc

SEQ ID NO: 4869 - RNA, 10 nt, Unknown
  source: /note="Description of Unknown: Exemplary gene or splice site sequence"
caggugccau

SEQ ID NO: 4870 - RNA, 10 nt, Unknown
  source: /note="Description of Unknown: Exemplary gene or splice site sequence"
agagugguga

SEQ ID NO: 4871 - RNA, 10 nt, Unknown
  source: /note="Description of Unknown: Exemplary gene or splice site sequence"
guuguaagaa

SEQ ID NO: 4872 - RNA, 10 nt, Unknown
  source: /note="Description of Unknown: Exemplary gene or splice site sequence"
agaguaaaua

SEQ ID NO: 4873 - RNA, 10 nt, Unknown
  source: /note="Description of Unknown: Exemplary gene or splice site sequence"
agggugaagg

SEQ ID NO: 4874 - RNA, 10 nt, Unknown
  source: /note="Description of Unknown: Exemplary gene or splice site sequence"
cugguagauu

SEQ ID NO: 4875 - RNA, 10 nt, Unknown
  source: /note="Description of Unknown: Exemplary gene or splice site sequence"
gagguucagg

SEQ ID NO: 4876 - RNA, 10 nt, Unknown
  source: /note="Description of Unknown: Exemplary gene or splice site sequence"
agggucuuca

SEQ ID NO: 4877 - RNA, 10 nt, Unknown
  source: /note="Description of Unknown: Exemplary gene or splice site sequence"
cugguaaccu

SEQ ID NO: 4878 - RNA, 10 nt, Unknown
  source: /note="Description of Unknown: Exemplary gene or splice site sequence"
acaguacuga

SEQ ID NO: 4879 - RNA, 10 nt, Unknown
  source: /note="Description of Unknown: Exemplary gene or splice site sequence"
agaguggguc

SEQ ID NO: 4880 - RNA, 10 nt, Unknown
  source: /note="Description of Unknown: Exemplary gene or splice site sequence"
augguaugag

SEQ ID NO: 4881 - RNA, 10 nt, Unknown
  source: /note="Description of Unknown: Exemplary gene or splice site sequence"
aagguuauau

SEQ ID NO: 4882 - RNA, 10 nt, Unknown
  source: /note="Description of Unknown: Exemplary gene or splice site sequence"
agaguauagu

SEQ ID NO: 4883 - RNA, 10 nt, Unknown
  source: /note="Description of Unknown: Exemplary gene or splice site sequence"
aaaguaugaa

SEQ ID NO: 4884 - RNA, 10 nt, Unknown
  source: /note="Description of Unknown: Exemplary gene or splice site sequence"
uagguggcua

SEQ ID NO: 4885 - RNA, 10 nt, Unknown
  source: /note="Description of Unknown: Exemplary gene or splice site sequence"
accguauggg

SEQ ID NO: 4886 - RNA, 10 nt, Unknown
  source: /note="Description of Unknown: Exemplary gene or splice site sequence"
aaaguauaau

SEQ ID NO: 4887 - RNA, 10 nt, Unknown
  source: /note="Description of Unknown: Exemplary gene or splice site sequence"
uuuguauggc

SEQ ID NO: 4888 - RNA, 10 nt, Unknown
  source: /note="Description of Unknown: Exemplary gene or splice site sequence"
ggggucgcgu

SEQ ID NO: 4889 - RNA, 10 nt, Unknown
  source: /note="Description of Unknown: Exemplary gene or splice site sequence"
guggugguuu

SEQ ID NO: 4890 - RNA, 10 nt, Unknown
  source: /note="Description of Unknown: Exemplary gene or splice site sequence"
cagguuugac

SEQ ID NO: 4891 - RNA, 10 nt, Unknown
  source: /note="Description of Unknown: Exemplary gene or splice site sequence"
ggaguaggcg

SEQ ID NO: 4892 - RNA, 10 nt, Unknown
  source: /note="Description of Unknown: Exemplary gene or splice site sequence"
gagguacccu

SEQ ID NO: 4893 - RNA, 10 nt, Unknown
  source: /note="Description of Unknown: Exemplary gene or splice site sequence"
auggugugca

SEQ ID NO: 4894 - RNA, 10 nt, Unknown
  source: /note="Description of Unknown: Exemplary gene or splice site sequence"
gugguuggug

SEQ ID NO: 4895 - RNA, 10 nt, Unknown
  source: /note="Description of Unknown: Exemplary gene or splice site sequence"
aaaguaugcu

SEQ ID NO: 4896 - RNA, 10 nt, Unknown
  source: /note="Description of Unknown: Exemplary gene or splice site sequence"
uaaguuacau

SEQ ID NO: 4897 - RNA, 10 nt, Unknown
  source: /note="Description of Unknown: Exemplary gene or splice site sequence"
acaguaugag

SEQ ID NO: 4898 - RNA, 10 nt, Unknown
  source: /note="Description of Unknown: Exemplary gene or splice site sequence"
ggaguauguu

SEQ ID NO: 4899 - RNA, 10 nt, Unknown
  source: /note="Description of Unknown: Exemplary gene or splice site sequence"
uuugugagaa

SEQ ID NO: 4900 - RNA, 10 nt, Unknown
  source: /note="Description of Unknown: Exemplary gene or splice site sequence"
aaugugcguu

SEQ ID NO: 4901 - RNA, 10 nt, Unknown
  source: /note="Description of Unknown: Exemplary gene or splice site sequence"
cagguagagu

SEQ ID NO: 4902 - RNA, 10 nt, Unknown
  source: /note="Description of Unknown: Exemplary gene or splice site sequence"
augguguuaa

SEQ ID NO: 4903 - RNA, 10 nt, Unknown
  source: /note="Description of Unknown: Exemplary gene or splice site sequence"
caugugcguc

SEQ ID NO: 4904 - RNA, 10 nt, Unknown
  source: /note="Description of Unknown: Exemplary gene or splice site sequence"
auaguuggau

SEQ ID NO: 4905 - RNA, 10 nt, Unknown
  source: /note="Description of Unknown: Exemplary gene or splice site sequence"
gagguacgua

SEQ ID NO: 4906 - RNA, 10 nt, Unknown
  source: /note="Description of Unknown: Exemplary gene or splice site sequence"
guugugagaa

SEQ ID NO: 4907 - RNA, 10 nt, Unknown
  source: /note="Description of Unknown: Exemplary gene or splice site sequence"
caaguacauc

SEQ ID NO: 4908 - RNA, 10 nt, Unknown
  source: /note="Description of Unknown: Exemplary gene or splice site sequence"
gagguaguuu

SEQ ID NO: 4909 - RNA, 10 nt, Unknown
  source: /note="Description of Unknown: Exemplary gene or splice site sequence"
acuguacaga

SEQ ID NO: 4910 - RNA, 10 nt, Unknown
  source: /note="Description of Unknown: Exemplary gene or splice site sequence"
ccgguuguga

SEQ ID NO: 4911 - RNA, 10 nt, Unknown
  source: /note="Description of Unknown: Exemplary gene or splice site sequence"
ugggucagug

SEQ ID NO: 4912 - RNA, 10 nt, Unknown
  source: /note="Description of Unknown: Exemplary gene or splice site sequence"
guaguaagaa

SEQ ID NO: 4913 - RNA, 10 nt, Unknown
  source: /note="Description of Unknown: Exemplary gene or splice site sequence"
gacguacuuu

SEQ ID NO: 4914 - RNA, 10 nt, Unknown
  source: /note="Description of Unknown: Exemplary gene or splice site sequence"
agagucaguc

SEQ ID NO: 4915 - RNA, 10 nt, Unknown
  source: /note="Description of Unknown: Exemplary gene or splice site sequence"
uagguuaguu

SEQ ID NO: 4916 - RNA, 10 nt, Unknown
  source: /note="Description of Unknown: Exemplary gene or splice site sequence"
agggcagcag

SEQ ID NO: 4917 - RNA, 10 nt, Unknown
  source: /note="Description of Unknown: Exemplary gene or splice site sequence"
aagguccuac

SEQ ID NO: 4918 - RNA, 10 nt, Unknown
  source: /note="Description of Unknown: Exemplary gene or splice site sequence"
aauguaauug

SEQ ID NO: 4919 - RNA, 10 nt, Unknown
  source: /note="Description of Unknown: Exemplary gene or splice site sequence"
caggugcggg

SEQ ID NO: 4920 - RNA, 10 nt, Unknown
  source: /note="Description of Unknown: Exemplary gene or splice site sequence"
cugguaaugg

SEQ ID NO: 4921 - RNA, 10 nt, Unknown
  source: /note="Description of Unknown: Exemplary gene or splice site sequence"
caaguagccc

SEQ ID NO: 4922 - RNA, 10 nt, Unknown
  source: /note="Description of Unknown: Exemplary gene or splice site sequence"
gaagucaguu

SEQ ID NO: 4923 - RNA, 10 nt, Unknown
  source: /note="Description of Unknown: Exemplary gene or splice site sequence"
acaguaauug

SEQ ID NO: 4924 - RNA, 10 nt, Unknown
  source: /note="Description of Unknown: Exemplary gene or splice site sequence"
uuaguuagua

SEQ ID NO: 4925 - RNA, 10 nt, Unknown
  source: /note="Description of Unknown: Exemplary gene or splice site sequence"
ccuguauuuu

SEQ ID NO: 4926 - RNA, 10 nt, Unknown
  source: /note="Description of Unknown: Exemplary gene or splice site sequence"
aucguaagaa

SEQ ID NO: 4927 - RNA, 10 nt, Unknown
  source: /note="Description of Unknown: Exemplary gene or splice site sequence"
ccagugagca

SEQ ID NO: 4928 - RNA, 10 nt, Unknown
  source: /note="Description of Unknown: Exemplary gene or splice site sequence"
gaaguaaggc

SEQ ID NO: 4929 - RNA, 10 nt, Unknown
  source: /note="Description of Unknown: Exemplary gene or splice site sequence"
ugagugggua

SEQ ID NO: 4930 - RNA, 10 nt, Unknown
  source: /note="Description of Unknown: Exemplary gene or splice site sequence"
ucagugguag

SEQ ID NO: 4931 - RNA, 10 nt, Unknown
  source: /note="Description of Unknown: Exemplary gene or splice site sequence"
ucuguacagg

SEQ ID NO: 4932 - RNA, 10 nt, Unknown
  source: /note="Description of Unknown: Exemplary gene or splice site sequence"
cgagugagug

SEQ ID NO: 4933 - RNA, 10 nt, Unknown
  source: /note="Description of Unknown: Exemplary gene or splice site sequence"
uccguaugug

SEQ ID NO: 4934 - RNA, 10 nt, Unknown
  source: /note="Description of Unknown: Exemplary gene or splice site sequence"
caugccguuu

SEQ ID NO: 4935 - RNA, 10 nt, Unknown
  source: /note="Description of Unknown: Exemplary gene or splice site sequence"
aaagugacuu

SEQ ID NO: 4936 - RNA, 10 nt, Unknown
  source: /note="Description of Unknown: Exemplary gene or splice site sequence"
agaguaggca

SEQ ID NO: 4937 - RNA, 10 nt, Unknown
  source: /note="Description of Unknown: Exemplary gene or splice site sequence"
gaaguaagag

SEQ ID NO: 4938 - RNA, 10 nt, Unknown
  source: /note="Description of Unknown: Exemplary gene or splice site sequence"
caggcagguu

SEQ ID NO: 4939 - RNA, 10 nt, Unknown
  source: /note="Description of Unknown: Exemplary gene or splice site sequence"
uugguagagc

SEQ ID NO: 4940 - RNA, 10 nt, Unknown
  source: /note="Description of Unknown: Exemplary gene or splice site sequence"
aagguggaaa

SEQ ID NO: 4941 - RNA, 10 nt, Unknown
  source: /note="Description of Unknown: Exemplary gene or splice site sequence"
gaggcagguc

SEQ ID NO: 4942 - RNA, 10 nt, Unknown
  source: /note="Description of Unknown: Exemplary gene or splice site sequence"
augguacgac

SEQ ID NO: 4943 - RNA, 10 nt, Unknown
  source: /note="Description of Unknown: Exemplary gene or splice site sequence"
aggguaggaa

SEQ ID NO: 4944 - RNA, 10 nt, Unknown
  source: /note="Description of Unknown: Exemplary gene or splice site sequence"
aggguaggua

SEQ ID NO: 4945 - RNA, 10 nt, Unknown
  source: /note="Description of Unknown: Exemplary gene or splice site sequence"
uugguaaggu

SEQ ID NO: 4946 - RNA, 10 nt, Unknown
  source: /note="Description of Unknown: Exemplary gene or splice site sequence"
augguacaga

SEQ ID NO: 4947 - RNA, 10 nt, Unknown
  source: /note="Description of Unknown: Exemplary gene or splice site sequence"
cagguagagc

SEQ ID NO: 4948 - RNA, 10 nt, Unknown
  source: /note="Description of Unknown: Exemplary gene or splice site sequence"
uagguaaggu

SEQ ID NO: 4949 - RNA, 10 nt, Unknown
  source: /note="Description of Unknown: Exemplary gene or splice site sequence"
gggguuagag

SEQ ID NO: 4950 - RNA, 10 nt, Unknown
  source: /note="Description of Unknown: Exemplary gene or splice site sequence"
aagguaucaa

SEQ ID NO: 4951 - RNA, 10 nt, Unknown
  source: /note="Description of Unknown: Exemplary gene or splice site sequence"
gagguagccc

SEQ ID NO: 4952 - RNA, 10 nt, Unknown
  source: /note="Description of Unknown: Exemplary gene or splice site sequence"
caggugccuc

SEQ ID NO: 4953 - RNA, 10 nt, Unknown
  source: /note="Description of Unknown: Exemplary gene or splice site sequence"
gcaguaagag

SEQ ID NO: 4954 - RNA, 10 nt, Unknown
  source: /note="Description of Unknown: Exemplary gene or splice site sequence"
acgguagagu

SEQ ID NO: 4955 - RNA, 10 nt, Unknown
  source: /note="Description of Unknown: Exemplary gene or splice site sequence"
uggguaaugg

SEQ ID NO: 4956 - RNA, 10 nt, Unknown
  source: /note="Description of Unknown: Exemplary gene or splice site sequence"
cuggucaguu

SEQ ID NO: 4957 - RNA, 10 nt, Unknown
  source: /note="Description of Unknown: Exemplary gene or splice site sequence"
gugguacauu

SEQ ID NO: 4958 - RNA, 10 nt, Unknown
  source: /note="Description of Unknown: Exemplary gene or splice site sequence"
aaaguagguu

SEQ ID NO: 4959 - RNA, 10 nt, Unknown
  source: /note="Description of Unknown: Exemplary gene or splice site sequence"
aaggccaaga

SEQ ID NO: 4960 - RNA, 10 nt, Unknown
  source: /note="Description of Unknown: Exemplary gene or splice site sequence"
cgggugggca

SEQ ID NO: 4961 - RNA, 10 nt, Unknown
  source: /note="Description of Unknown: Exemplary gene or splice site sequence"
acgguccggg

SEQ ID NO: 4962 - RNA, 10 nt, Unknown
  source: /note="Description of Unknown: Exemplary gene or splice site sequence"
cgaguaugag

SEQ ID NO: 4963 - RNA, 10 nt, Unknown
  source: /note="Description of Unknown: Exemplary gene or splice site sequence"
cugguaugcc

SEQ ID NO: 4964 - RNA, 10 nt, Unknown
  source: /note="Description of Unknown: Exemplary gene or splice site sequence"
gagguggaug

SEQ ID NO: 4965 - RNA, 10 nt, Unknown
  source: /note="Description of Unknown: Exemplary gene or splice site sequence"
caggccuuuc

SEQ ID NO: 4966 - RNA, 10 nt, Unknown
  source: /note="Description of Unknown: Exemplary gene or splice site sequence"
aaaguacauc

SEQ ID NO: 4967 - RNA, 10 nt, Unknown
  source: /note="Description of Unknown: Exemplary gene or splice site sequence"
aaaguaauca

SEQ ID NO: 4968 - RNA, 10 nt, Unknown
  source: /note="Description of Unknown: Exemplary gene or splice site sequence"
gagguaacug

SEQ ID NO: 4969 - RNA, 10 nt, Unknown
  source: /note="Description of Unknown: Exemplary gene or splice site sequence"
cugguaaaga

SEQ ID NO: 4970 - RNA, 10 nt, Unknown
  source: /note="Description of Unknown: Exemplary gene or splice site sequence"
cguguaagca

SEQ ID NO: 4971 - RNA, 10 nt, Unknown
  source: /note="Description of Unknown: Exemplary gene or splice site sequence"
ugggcaagua

SEQ ID NO: 4972 - RNA, 10 nt, Unknown
  source: /note="Description of Unknown: Exemplary gene or splice site sequence"
gcgguggcga

SEQ ID NO: 4973 - RNA, 10 nt, Unknown
  source: /note="Description of Unknown: Exemplary gene or splice site sequence"
gagguggccg

SEQ ID NO: 4974 - RNA, 10 nt, Unknown
  source: /note="Description of Unknown: Exemplary gene or splice site sequence"
auugcaugca

SEQ ID NO: 4975 - RNA, 10 nt, Unknown
  source: /note="Description of Unknown: Exemplary gene or splice site sequence"
acggugacug

SEQ ID NO: 4976 - RNA, 10 nt, Unknown
  source: /note="Description of Unknown: Exemplary gene or splice site sequence"
caggucagau

SEQ ID NO: 4977 - RNA, 10 nt, Unknown
  source: /note="Description of Unknown: Exemplary gene or splice site sequence"
agaguaacuc

SEQ ID NO: 4978 - RNA, 10 nt, Unknown
  source: /note="Description of Unknown: Exemplary gene or splice site sequence"
ugaguaacag

SEQ ID NO: 4979 - RNA, 10 nt, Unknown
  source: /note="Description of Unknown: Exemplary gene or splice site sequence"
aagguacccg

SEQ ID NO: 4980 - RNA, 10 nt, Unknown
  source: /note="Description of Unknown: Exemplary gene or splice site sequence"
aggguaggcu

SEQ ID NO: 4981 - RNA, 10 nt, Unknown
  source: /note="Description of Unknown: Exemplary gene or splice site sequence"
ggggcaggac

SEQ ID NO: 4982 - RNA, 10 nt, Unknown
  source: /note="Description of Unknown: Exemplary gene or splice site sequence"
ccuguaagug

SEQ ID NO: 4983 - RNA, 10 nt, Unknown
  source: /note="Description of Unknown: Exemplary gene or splice site sequence"
auuguaagug

SEQ ID NO: 4984 - RNA, 10 nt, Unknown
  source: /note="Description of Unknown: Exemplary gene or splice site sequence"
acuguacgag

SEQ ID NO: 4985 - RNA, 10 nt, Unknown
  source: /note="Description of Unknown: Exemplary gene or splice site sequence"
guaguagugu

SEQ ID NO: 4986 - RNA, 10 nt, Unknown
  source: /note="Description of Unknown: Exemplary gene or splice site sequence"
agaguaugag

SEQ ID NO: 4987 - RNA, 10 nt, Unknown
  source: /note="Description of Unknown: Exemplary gene or splice site sequence"
ucaguguggg

SEQ ID NO: 4988 - RNA, 10 nt, Unknown
  source: /note="Description of Unknown: Exemplary gene or splice site sequence"
uggguauaua

SEQ ID NO: 4989 - RNA, 10 nt, Unknown
  source: /note="Description of Unknown: Exemplary gene or splice site sequence"
uagguagcua

SEQ ID NO: 4990 - RNA, 10 nt, Unknown
  source: /note="Description of Unknown: Exemplary gene or splice site sequence"
gggguaaaga

SEQ ID NO: 4991 - RNA, 10 nt, Unknown
  source: /note="Description of Unknown: Exemplary gene or splice site sequence"
aggguuacuu

SEQ ID NO: 4992 - RNA, 10 nt, Unknown
  source: /note="Description of Unknown: Exemplary gene or splice site sequence"
cauguaaaug

SEQ ID NO: 4993 - RNA, 10 nt, Unknown
  source: /note="Description of Unknown: Exemplary gene or splice site sequence"
ggaguaguaa

SEQ ID NO: 4994 - RNA, 10 nt, Unknown
  source: /note="Description of Unknown: Exemplary gene or splice site sequence"
caggucaauc

SEQ ID NO: 4995 - RNA, 10 nt, Unknown
  source: /note="Description of Unknown: Exemplary gene or splice site sequence"
cggguuagug

SEQ ID NO: 4996 - RNA, 10 nt, Unknown
  source: /note="Description of Unknown: Exemplary gene or splice site sequence"
uagguacaug

SEQ ID NO: 4997 - RNA, 10 nt, Unknown
  source: /note="Description of Unknown: Exemplary gene or splice site sequence"
uagguuaaga

SEQ ID NO: 4998 - RNA, 10 nt, Unknown
  source: /note="Description of Unknown: Exemplary gene or splice site sequence"
uggguaccuu

SEQ ID NO: 4999 - RNA, 10 nt, Unknown
  source: /note="Description of Unknown: Exemplary gene or splice site sequence"
cggguggaca

SEQ ID NO: 5000 - RNA, 10 nt, Unknown
  source: /note="Description of Unknown: Exemplary gene or splice site sequence"
caggucuuac

SEQ ID NO: 5001 - RNA, 10 nt, Unknown
  source: /note="Description of Unknown: Exemplary gene or splice site sequence"
aagguggagc

SEQ ID NO: 5002 - RNA, 10 nt, Unknown
  source: /note="Description of Unknown: Exemplary gene or splice site sequence"
augguaacca

SEQ ID NO: 5003 - RNA, 10 nt, Unknown
  source: /note="Description of Unknown: Exemplary gene or splice site sequence"
ucgguaaguu

SEQ ID NO: 5004 - RNA, 10 nt, Unknown
  source: /note="Description of Unknown: Exemplary gene or splice site sequence"
uauguacaaa

SEQ ID NO: 5005 - RNA, 10 nt, Unknown
  source: /note="Description of Unknown: Exemplary gene or splice site sequence"
aauguagauu

SEQ ID NO: 5006 - RNA, 10 nt, Unknown
  source: /note="Description of Unknown: Exemplary gene or splice site sequence"
guagcuagua

SEQ ID NO: 5007 - RNA, 10 nt, Unknown
  source: /note="Description of Unknown: Exemplary gene or splice site sequence"
aagguauugg

SEQ ID NO: 5008 - RNA, 10 nt, Unknown
  source: /note="Description of Unknown: Exemplary gene or splice site sequence"
gaggucuuug

SEQ ID NO: 5009 - RNA, 10 nt, Unknown
  source: /note="Description of Unknown: Exemplary gene or splice site sequence"
gaaguucagg

SEQ ID NO: 5010 - RNA, 10 nt, Unknown
  source: /note="Description of Unknown: Exemplary gene or splice site sequence"
uggguaucac

SEQ ID NO: 5011 - RNA, 10 nt, Unknown
  source: /note="Description of Unknown: Exemplary gene or splice site sequence"
agaguacugg

SEQ ID NO: 5012 - RNA, 10 nt, Unknown
  source: /note="Description of Unknown: Exemplary gene or splice site sequence"
cagguuaaug

SEQ ID NO: 5013 - RNA, 10 nt, Unknown
  source: /note="Description of Unknown: Exemplary gene or splice site sequence"
aggguacgug

SEQ ID NO: 5014 - RNA, 10 nt, Unknown
  source: /note="Description of Unknown: Exemplary gene or splice site sequence"
agggcacagg

SEQ ID NO: 5015 - RNA, 10 nt, Unknown
  source: /note="Description of Unknown: Exemplary gene or splice site sequence"
cugguuaguu

SEQ ID NO: 5016 - RNA, 10 nt, Unknown
  source: /note="Description of Unknown: Exemplary gene or splice site sequence"
uugguacgag

SEQ ID NO: 5017 - RNA, 10 nt, Unknown
  source: /note="Description of Unknown: Exemplary gene or splice site sequence"
acggugauca

SEQ ID NO: 5018 - RNA, 10 nt, Unknown
  source: /note="Description of Unknown: Exemplary gene or splice site sequence"
ccugugagag

SEQ ID NO: 5019 - RNA, 10 nt, Unknown
  source: /note="Description of Unknown: Exemplary gene or splice site sequence"
gaggugaagu

SEQ ID NO: 5020 - RNA, 10 nt, Unknown
  source: /note="Description of Unknown: Exemplary gene or splice site sequence"
aagguacauc

SEQ ID NO: 5021 - RNA, 10 nt, Unknown
  source: /note="Description of Unknown: Exemplary gene or splice site sequence"
ucuguaugug

SEQ ID NO: 5022 - RNA, 10 nt, Unknown
  source: /note="Description of Unknown: Exemplary gene or splice site sequence"
uugguggaag

SEQ ID NO: 5023 - RNA, 10 nt, Unknown
  source: /note="Description of Unknown: Exemplary gene or splice site sequence"
ugggcagguu

SEQ ID NO: 5024 - RNA, 10 nt, Unknown
  source: /note="Description of Unknown: Exemplary gene or splice site sequence"
gaaguggagc

SEQ ID NO: 5025 - RNA, 10 nt, Unknown
  source: /note="Description of Unknown: Exemplary gene or splice site sequence"
acaguaagac

SEQ ID NO: 5026 - RNA, 10 nt, Unknown
  source: /note="Description of Unknown: Exemplary gene or splice site sequence"
cggguaccaa

SEQ ID NO: 5027 - RNA, 10 nt, Unknown
  source: /note="Description of Unknown: Exemplary gene or splice site sequence"
caaguacguc

SEQ ID NO: 5028 - RNA, 10 nt, Unknown
  source: /note="Description of Unknown: Exemplary gene or splice site sequence"
agagugaggg

SEQ ID NO: 5029 - RNA, 10 nt, Unknown
  source: /note="Description of Unknown: Exemplary gene or splice site sequence"
cggguaagaa

SEQ ID NO: 5030 - RNA, 10 nt, Unknown
  source: /note="Description of Unknown: Exemplary gene or splice site sequence"
aauguaggug

SEQ ID NO: 5031 - RNA, 10 nt, Unknown
  source: /note="Description of Unknown: Exemplary gene or splice site sequence"
aucgugugcu

SEQ ID NO: 5032 - RNA, 10 nt, Unknown
  source: /note="Description of Unknown: Exemplary gene or splice site sequence"
uaggucaugg

SEQ ID NO: 5033 - RNA, 10 nt, Unknown
  source: /note="Description of Unknown: Exemplary gene or splice site sequence"
cagguuuuga

SEQ ID NO: 5034 - RNA, 10 nt, Unknown
  source: /note="Description of Unknown: Exemplary gene or splice site sequence"
aaggcaugca

SEQ ID NO: 5035 - RNA, 10 nt, Unknown
  source: /note="Description of Unknown: Exemplary gene or splice site sequence"
gaggugcugc

SEQ ID NO: 5036 - RNA, 10 nt, Unknown
  source: /note="Description of Unknown: Exemplary gene or splice site sequence"
aagguuaaua

SEQ ID NO: 5037 - RNA, 10 nt, Unknown
  source: /note="Description of Unknown: Exemplary gene or splice site sequence"
cagguucauc

SEQ ID NO: 5038 - RNA, 10 nt, Unknown
  source: /note="Description of Unknown: Exemplary gene or splice site sequence"
gcgguaggug

SEQ ID NO: 5039 - RNA, 10 nt, Unknown
  source: /note="Description of Unknown: Exemplary gene or splice site sequence"
gacgugagua

SEQ ID NO: 5040 - RNA, 10 nt, Unknown
  source: /note="Description of Unknown: Exemplary gene or splice site sequence"
caggucuacu

SEQ ID NO: 5041 - RNA, 10 nt, Unknown
  source: /note="Description of Unknown: Exemplary gene or splice site sequence"
uugguaugag

SEQ ID NO: 5042 - RNA, 10 nt, Unknown
  source: /note="Description of Unknown: Exemplary gene or splice site sequence"
agcgugggca

SEQ ID NO: 5043 - RNA, 10 nt, Unknown
  source: /note="Description of Unknown: Exemplary gene or splice site sequence"
augguaaggu

SEQ ID NO: 5044 - RNA, 10 nt, Unknown
  source: /note="Description of Unknown: Exemplary gene or splice site sequence"
augguaccuc

SEQ ID NO: 5045 - RNA, 10 nt, Unknown
  source: /note="Description of Unknown: Exemplary gene or splice site sequence"
uugguauggu

SEQ ID NO: 5046 - RNA, 10 nt, Unknown
  source: /note="Description of Unknown: Exemplary gene or splice site sequence"
uauguaugaa

SEQ ID NO: 5047 - RNA, 10 nt, Unknown
  source: /note="Description of Unknown: Exemplary gene or splice site sequence"
uggguauggg

SEQ ID NO: 5048 - RNA, 10 nt, Unknown
  source: /note="Description of Unknown: Exemplary gene or splice site sequence"
gauguaaaua

SEQ ID NO: 5049 - RNA, 10 nt, Unknown
  source: /note="Description of Unknown: Exemplary gene or splice site sequence"
ccgguaaguu

SEQ ID NO: 5050 - RNA, 10 nt, Unknown
  source: /note="Description of Unknown: Exemplary gene or splice site sequence"
gaggucugaa

SEQ ID NO: 5051 - RNA, 10 nt, Unknown
  source: /note="Description of Unknown: Exemplary gene or splice site sequence"
gaggugcgag

SEQ ID NO: 5052 - RNA, 10 nt, Unknown
  source: /note="Description of Unknown: Exemplary gene or splice site sequence"
cuggucagcc

SEQ ID NO: 5053 - RNA, 10 nt, Unknown
  source: /note="Description of Unknown: Exemplary gene or splice site sequence"
cagguuuugu

SEQ ID NO: 5054 - RNA, 10 nt, Unknown
  source: /note="Description of Unknown: Exemplary gene or splice site sequence"
cggguggugu

SEQ ID NO: 5055 - RNA, 10 nt, Unknown
  source: /note="Description of Unknown: Exemplary gene or splice site sequence"
uaaguuagua

SEQ ID NO: 5056 - RNA, 10 nt, Unknown
  source: /note="Description of Unknown: Exemplary gene or splice site sequence"
uuugugugug

SEQ ID NO: 5057 - RNA, 10 nt, Unknown
  source: /note="Description of Unknown: Exemplary gene or splice site sequence"
cagguuaacc

SEQ ID NO: 5058 - RNA, 10 nt, Unknown
  source: /note="Description of Unknown: Exemplary gene or splice site sequence"
uugguacuuu

SEQ ID NO: 5059 - RNA, 10 nt, Unknown
  source: /note="Description of Unknown: Exemplary gene or splice site sequence"
gcuguaaggc

SEQ ID NO: 5060 - RNA, 10 nt, Unknown
  source: /note="Description of Unknown: Exemplary gene or splice site sequence"
aggguggcug

SEQ ID NO: 5061 - RNA, 10 nt, Unknown
  source: /note="Description of Unknown: Exemplary gene or splice site sequence"
gauguaaaaa

SEQ ID NO: 5062 - RNA, 10 nt, Unknown
  source: /note="Description of Unknown: Exemplary gene or splice site sequence"
aaggucaaaa

SEQ ID NO: 5063 - RNA, 10 nt, Unknown
  source: /note="Description of Unknown: Exemplary gene or splice site sequence"
cagguagcgc

SEQ ID NO: 5064 - RNA, 10 nt, Unknown
  source: /note="Description of Unknown: Exemplary gene or splice site sequence"
cagguuuggc

SEQ ID NO: 5065 - RNA, 10 nt, Unknown
  source: /note="Description of Unknown: Exemplary gene or splice site sequence"
gaggugguuu

SEQ ID NO: 5066 - RNA, 10 nt, Unknown
  source: /note="Description of Unknown: Exemplary gene or splice site sequence"
cggguaaaua

SEQ ID NO: 5067 - RNA, 10 nt, Unknown
  source: /note="Description of Unknown: Exemplary gene or splice site sequence"
cugguucggu

SEQ ID NO: 5068 - RNA, 10 nt, Unknown
  source: /note="Description of Unknown: Exemplary gene or splice site sequence"
ggagugagcc

SEQ ID NO: 5069 - RNA, 10 nt, Unknown
  source: /note="Description of Unknown: Exemplary gene or splice site sequence"
aaggugcgcg

SEQ ID NO: 5070 - RNA, 10 nt, Unknown
  source: /note="Description of Unknown: Exemplary gene or splice site sequence"
gaaguacauc

SEQ ID NO: 5071 - RNA, 10 nt, Unknown
  source: /note="Description of Unknown: Exemplary gene or splice site sequence"
agugucugua

SEQ ID NO: 5072 - RNA, 10 nt, Unknown
  source: /note="Description of Unknown: Exemplary gene or splice site sequence"
cccgugagcu

SEQ ID NO: 5073 - RNA, 10 nt, Unknown
  source: /note="Description of Unknown: Exemplary gene or splice site sequence"
gagguucaca

SEQ ID NO: 5074 - RNA, 10 nt, Unknown
  source: /note="Description of Unknown: Exemplary gene or splice site sequence"
cuagugggua

SEQ ID NO: 5075 - RNA, 10 nt, Unknown
  source: /note="Description of Unknown: Exemplary gene or splice site sequence"
gagguaacua

SEQ ID NO: 5076 - RNA, 10 nt, Unknown
  source: /note="Description of Unknown: Exemplary gene or splice site sequence"
ucgguauguc

SEQ ID NO: 5077 - RNA, 10 nt, Unknown
  source: /note="Description of Unknown: Exemplary gene or splice site sequence"
uaaguauuug

SEQ ID NO: 5078 - RNA, 10 nt, Unknown
  source: /note="Description of Unknown: Exemplary gene or splice site sequence"
cagguaagcg

SEQ ID NO: 5079 - RNA, 10 nt, Unknown
  source: /note="Description of Unknown: Exemplary gene or splice site sequence"
gaggugguaa

SEQ ID NO: 5080 - RNA, 10 nt, Unknown
  source: /note="Description of Unknown: Exemplary gene or splice site sequence"
cgaguaagag

SEQ ID NO: 5081 - RNA, 10 nt, Unknown
  source: /note="Description of Unknown: Exemplary gene or splice site sequence"
ccgguaagcu

SEQ ID NO: 5082 - RNA, 10 nt, Unknown
  source: /note="Description of Unknown: Exemplary gene or splice site sequence"
gaggucuugu

SEQ ID NO: 5083 - RNA, 10 nt, Unknown
  source: /note="Description of Unknown: Exemplary gene or splice site sequence"
aagguggguc

SEQ ID NO: 5084 - RNA, 10 nt, Unknown
  source: /note="Description of Unknown: Exemplary gene or splice site sequence"
cacguaagug

SEQ ID NO: 5085 - RNA, 10 nt, Unknown
  source: /note="Description of Unknown: Exemplary gene or splice site sequence"
aguguaauga

SEQ ID NO: 5086 - RNA, 10 nt, Unknown
  source: /note="Description of Unknown: Exemplary gene or splice site sequence"
aaagugugua

SEQ ID NO: 5087 - RNA, 10 nt, Unknown
  source: /note="Description of Unknown: Exemplary gene or splice site sequence"
ggagugccaa

SEQ ID NO: 5088 - RNA, 10 nt, Unknown
  source: /note="Description of Unknown: Exemplary gene or splice site sequence"
cacgugaguu

SEQ ID NO: 5089 - RNA, 10 nt, Unknown
  source: /note="Description of Unknown: Exemplary gene or splice site sequence"
aagguuggau

SEQ ID NO: 5090 - RNA, 10 nt, Unknown
  source: /note="Description of Unknown: Exemplary gene or splice site sequence"
uauguaaaua

SEQ ID NO: 5091 - RNA, 10 nt, Unknown
  source: /note="Description of Unknown: Exemplary gene or splice site sequence"
cugguaggaa

SEQ ID NO: 5092 - RNA, 10 nt, Unknown
  source: /note="Description of Unknown: Exemplary gene or splice site sequence"
uauguaaacu

SEQ ID NO: 5093 - RNA, 10 nt, Unknown
  source: /note="Description of Unknown: Exemplary gene or splice site sequence"
aauguauuuu

SEQ ID NO: 5094 - RNA, 10 nt, Unknown
  source: /note="Description of Unknown: Exemplary gene or splice site sequence"
cuggcaagug

SEQ ID NO: 5095 - RNA, 10 nt, Unknown
  source: /note="Description of Unknown: Exemplary gene or splice site sequence"
ugugugguau

SEQ ID NO: 5096 - RNA, 10 nt, Unknown
  source: /note="Description of Unknown: Exemplary gene or splice site sequence"
uauguauguu

SEQ ID NO: 5097 - RNA, 10 nt, Unknown
  source: /note="Description of Unknown: Exemplary gene or splice site sequence"
uuggugacuc

SEQ ID NO: 5098 - RNA, 10 nt, Unknown
  source: /note="Description of Unknown: Exemplary gene or splice site sequence"
ggaguaaggu

SEQ ID NO: 5099 - RNA, 10 nt, Unknown
  source: /note="Description of Unknown: Exemplary gene or splice site sequence"
aagguagaug

SEQ ID NO: 5100 - RNA, 10 nt, Unknown
  source: /note="Description of Unknown: Exemplary gene or splice site sequence"
uggguagggu

SEQ ID NO: 5101 - RNA, 10 nt, Unknown
  source: /note="Description of Unknown: Exemplary gene or splice site sequence"
aauguaauuc

SEQ ID NO: 5102 - RNA, 10 nt, Unknown
  source: /note="Description of Unknown: Exemplary gene or splice site sequence"
gugguauggc

SEQ ID NO: 5103 - RNA, 10 nt, Unknown
  source: /note="Description of Unknown: Exemplary gene or splice site sequence"
ggaguggguu

SEQ ID NO: 5104 - RNA, 10 nt, Unknown
  source: /note="Description of Unknown: Exemplary gene or splice site sequence"
aggguaccac

SEQ ID NO: 5105 - RNA, 10 nt, Unknown
  source: /note="Description of Unknown: Exemplary gene or splice site sequence"
uaggugacag

SEQ ID NO: 5106 - RNA, 10 nt, Unknown
  source: /note="Description of Unknown: Exemplary gene or splice site sequence"
acaguaggca

SEQ ID NO: 5107 - RNA, 10 nt, Unknown
  source: /note="Description of Unknown: Exemplary gene or splice site sequence"
augguuugaa

SEQ ID NO: 5108 - RNA, 10 nt, Unknown
  source: /note="Description of Unknown: Exemplary gene or splice site sequence"
gcaguaacua

SEQ ID NO: 5109 - RNA, 10 nt, Unknown
  source: /note="Description of Unknown: Exemplary gene or splice site sequence"
ccgguaggua

SEQ ID NO: 5110 - RNA, 10 nt, Unknown
  source: /note="Description of Unknown: Exemplary gene or splice site sequence"
agaguaggcc

SEQ ID NO: 5111 - RNA, 10 nt, Unknown
  source: /note="Description of Unknown: Exemplary gene or splice site sequence"
aagguugaca

SEQ ID NO: 5112 - RNA, 10 nt, Unknown
  source: /note="Description of Unknown: Exemplary gene or splice site sequence"
cuggugugua

SEQ ID NO: 5113 - RNA, 10 nt, Unknown
  source: /note="Description of Unknown: Exemplary gene or splice site sequence"
gaagucuguc

SEQ ID NO: 5114 - RNA, 10 nt, Unknown
  source: /note="Description of Unknown: Exemplary gene or splice site sequence"
ugggcucgga

SEQ ID NO: 5115 - RNA, 10 nt, Unknown
  source: /note="Description of Unknown: Exemplary gene or splice site sequence"
cagguagccu

SEQ ID NO: 5116 - RNA, 10 nt, Unknown
  source: /note="Description of Unknown: Exemplary gene or splice site sequence"
agaguaggua

SEQ ID NO: 5117 - RNA, 10 nt, Unknown
  source: /note="Description of Unknown: Exemplary gene or splice site sequence"
uaaguauguc

SEQ ID NO: 5118 - RNA, 10 nt, Unknown
  source: /note="Description of Unknown: Exemplary gene or splice site sequence"
cugguauauc

SEQ ID NO: 5119 - RNA, 10 nt, Unknown
  source: /note="Description of Unknown: Exemplary gene or splice site sequence"
gagguguguu

SEQ ID NO: 5120 - RNA, 10 nt, Unknown
  source: /note="Description of Unknown: Exemplary gene or splice site sequence"
auggugcaug

SEQ ID NO: 5121 - RNA, 10 nt, Unknown
  source: /note="Description of Unknown: Exemplary gene or splice site sequence"
aagguacgcc

SEQ ID NO: 5122 - RNA, 10 nt, Unknown
  source: /note="Description of Unknown: Exemplary gene or splice site sequence"
ugaguaacua

SEQ ID NO: 5123 - RNA, 10 nt, Unknown
  source: /note="Description of Unknown: Exemplary gene or splice site sequence"
gaggugacag

SEQ ID NO: 5124 - RNA, 10 nt, Unknown
  source: /note="Description of Unknown: Exemplary gene or splice site sequence"
guuguccugu

SEQ ID NO: 5125 - RNA, 10 nt, Unknown
  source: /note="Description of Unknown: Exemplary gene or splice site sequence"
uuggugucuu

SEQ ID NO: 5126 - RNA, 10 nt, Unknown
  source: /note="Description of Unknown: Exemplary gene or splice site sequence"
aaugugaagg

SEQ ID NO: 5127 - RNA, 10 nt, Unknown
  source: /note="Description of Unknown: Exemplary gene or splice site sequence"
uugguggaua

SEQ ID NO: 5128 - RNA, 10 nt, Unknown
  source: /note="Description of Unknown: Exemplary gene or splice site sequence"
uagguguguu

SEQ ID NO: 5129 - RNA, 10 nt, Unknown
  source: /note="Description of Unknown: Exemplary gene or splice site sequence"
cuggcaaguu

SEQ ID NO: 5130 - RNA, 10 nt, Unknown
  source: /note="Description of Unknown: Exemplary gene or splice site sequence"
gcaguaagau

SEQ ID NO: 5131 - RNA, 10 nt, Unknown
  source: /note="Description of Unknown: Exemplary gene or splice site sequence"
gcgguggaaa

SEQ ID NO: 5132 - RNA, 10 nt, Unknown
  source: /note="Description of Unknown: Exemplary gene or splice site sequence"
ugcguccagc

SEQ ID NO: 5133 - RNA, 10 nt, Unknown
  source: /note="Description of Unknown: Exemplary gene or splice site sequence"
aaaguggagu

SEQ ID NO: 5134 - RNA, 10 nt, Unknown
  source: /note="Description of Unknown: Exemplary gene or splice site sequence"
cgugugagcc

SEQ ID NO: 5135 - RNA, 10 nt, Unknown
  source: /note="Description of Unknown: Exemplary gene or splice site sequence"
agaguacugu

SEQ ID NO: 5136 - RNA, 10 nt, Unknown
  source: /note="Description of Unknown: Exemplary gene or splice site sequence"
cagguauagc

SEQ ID NO: 5137 - RNA, 10 nt, Unknown
  source: /note="Description of Unknown: Exemplary gene or splice site sequence"
uacguaagga

SEQ ID NO: 5138 - RNA, 10 nt, Unknown
  source: /note="Description of Unknown: Exemplary gene or splice site sequence"
aaggucuuua

SEQ ID NO: 5139 - RNA, 10 nt, Unknown
  source: /note="Description of Unknown: Exemplary gene or splice site sequence"
aagguggucu

SEQ ID NO: 5140 - RNA, 10 nt, Unknown
  source: /note="Description of Unknown: Exemplary gene or splice site sequence"
gggguaaauu

SEQ ID NO: 5141 - RNA, 10 nt, Unknown
  source: /note="Description of Unknown: Exemplary gene or splice site sequence"
ucagugagga

SEQ ID NO: 5142 - RNA, 10 nt, Unknown
  source: /note="Description of Unknown: Exemplary gene or splice site sequence"
agaguacguu

SEQ ID NO: 5143 - RNA, 10 nt, Unknown
  source: /note="Description of Unknown: Exemplary gene or splice site sequence"
gaggucguca

SEQ ID NO: 5144 - RNA, 10 nt, Unknown
  source: /note="Description of Unknown: Exemplary gene or splice site sequence"
uagguuugau

SEQ ID NO: 5145 - RNA, 10 nt, Unknown
  source: /note="Description of Unknown: Exemplary gene or splice site sequence"
cauguaaacc

SEQ ID NO: 5146 - RNA, 10 nt, Unknown
  source: /note="Description of Unknown: Exemplary gene or splice site sequence"
aagguggcac

SEQ ID NO: 5147 - RNA, 10 nt, Unknown
  source: /note="Description of Unknown: Exemplary gene or splice site sequence"
cagguagaug

SEQ ID NO: 5148 - RNA, 10 nt, Unknown
  source: /note="Description of Unknown: Exemplary gene or splice site sequence"
aacguaaaag

SEQ ID NO: 5149 - RNA, 10 nt, Unknown
  source: /note="Description of Unknown: Exemplary gene or splice site sequence"
uaggucucug

SEQ ID NO: 5150 - RNA, 10 nt, Unknown
  source: /note="Description of Unknown: Exemplary gene or splice site sequence"
auaguaggug

SEQ ID NO: 5151 - RNA, 10 nt, Unknown
  source: /note="Description of Unknown: Exemplary gene or splice site sequence"
uaggcaagag

SEQ ID NO: 5152 - RNA, 10 nt, Unknown
  source: /note="Description of Unknown: Exemplary gene or splice site sequence"
uaggcacggc

SEQ ID NO: 5153 - RNA, 10 nt, Unknown
  source: /note="Description of Unknown: Exemplary gene or splice site sequence"
aaggucuuca

SEQ ID NO: 5154 - RNA, 10 nt, Unknown
  source: /note="Description of Unknown: Exemplary gene or splice site sequence"
ccaguaugcu

SEQ ID NO: 5155 - RNA, 10 nt, Unknown
  source: /note="Description of Unknown: Exemplary gene or splice site sequence"
caagugaguu

SEQ ID NO: 5156 - RNA, 10 nt, Unknown
  source: /note="Description of Unknown: Exemplary gene or splice site sequence"
caggucucaa

SEQ ID NO: 5157 - RNA, 10 nt, Unknown
  source: /note="Description of Unknown: Exemplary gene or splice site sequence"
cagguuacau

SEQ ID NO: 5158 - RNA, 10 nt, Unknown
  source: /note="Description of Unknown: Exemplary gene or splice site sequence"
ggagugagca

SEQ ID NO: 5159 - RNA, 10 nt, Unknown
  source: /note="Description of Unknown: Exemplary gene or splice site sequence"
agaguacgca

SEQ ID NO: 5160 - RNA, 10 nt, Unknown
  source: /note="Description of Unknown: Exemplary gene or splice site sequence"
cugguguugg

SEQ ID NO: 5161 - RNA, 10 nt, Unknown
  source: /note="Description of Unknown: Exemplary gene or splice site sequence"
aagguacuca

SEQ ID NO: 5162 - RNA, 10 nt, Unknown
  source: /note="Description of Unknown: Exemplary gene or splice site sequence"
cuaguaaggg

SEQ ID NO: 5163 - RNA, 10 nt, Unknown
  source: /note="Description of Unknown: Exemplary gene or splice site sequence"
agaguaaaag

SEQ ID NO: 5164 - RNA, 10 nt, Unknown
  source: /note="Description of Unknown: Exemplary gene or splice site sequence"
aagguaacga

SEQ ID NO: 5165 - RNA, 10 nt, Unknown
  source: /note="Description of Unknown: Exemplary gene or splice site sequence"
cugguccccg

SEQ ID NO: 5166 - RNA, 10 nt, Unknown
  source: /note="Description of Unknown: Exemplary gene or splice site sequence"
uaaguauggg

SEQ ID NO: 5167 - RNA, 10 nt, Unknown
  source: /note="Description of Unknown: Exemplary gene or splice site sequence"
gaggucgagc

SEQ ID NO: 5168 - RNA, 10 nt, Unknown
  source: /note="Description of Unknown: Exemplary gene or splice site sequence"
uugguauaua

SEQ ID NO: 5169 - RNA, 10 nt, Unknown
  source: /note="Description of Unknown: Exemplary gene or splice site sequence"
aaagucaagg

SEQ ID NO: 5170 - RNA, 10 nt, Unknown
  source: /note="Description of Unknown: Exemplary gene or splice site sequence"
aaggucuagg

SEQ ID NO: 5171 - RNA, 10 nt, Unknown
  source: /note="Description of Unknown: Exemplary gene or splice site sequence"
cgaguagguc

SEQ ID NO: 5172 - RNA, 10 nt, Unknown
  source: /note="Description of Unknown: Exemplary gene or splice site sequence"
aggguucguu

SEQ ID NO: 5173 - RNA, 10 nt, Unknown
  source: /note="Description of Unknown: Exemplary gene or splice site sequence"
gaggcaggcc

SEQ ID NO: 5174 - RNA, 10 nt, Unknown
  source: /note="Description of Unknown: Exemplary gene or splice site sequence"
cuaguauuac

SEQ ID NO: 5175 - RNA, 10 nt, Unknown
  source: /note="Description of Unknown: Exemplary gene or splice site sequence"
acgguaugug

SEQ ID NO: 5176 - RNA, 10 nt, Unknown
  source: /note="Description of Unknown: Exemplary gene or splice site sequence"
uaggugguuc

SEQ ID NO: 5177 - RNA, 10 nt, Unknown
  source: /note="Description of Unknown: Exemplary gene or splice site sequence"
agaguauaac

SEQ ID NO: 5178 - RNA, 10 nt, Unknown
  source: /note="Description of Unknown: Exemplary gene or splice site sequence"
uuggugcguc

SEQ ID NO: 5179 - RNA, 10 nt, Unknown
  source: /note="Description of Unknown: Exemplary gene or splice site sequence"
accguuaucu

SEQ ID NO: 5180 - RNA, 10 nt, Unknown
  source: /note="Description of Unknown: Exemplary gene or splice site sequence"
ccagugauga

SEQ ID NO: 5181 - RNA, 10 nt, Unknown
  source: /note="Description of Unknown: Exemplary gene or splice site sequence"
gaaguaugca

SEQ ID NO: 5182 - RNA, 10 nt, Unknown
  source: /note="Description of Unknown: Exemplary gene or splice site sequence"
gaaguauggc

SEQ ID NO: 5183 - RNA, 10 nt, Unknown
  source: /note="Description of Unknown: Exemplary gene or splice site sequence"
ccgguaggac

SEQ ID NO: 5184 - RNA, 10 nt, Unknown
  source: /note="Description of Unknown: Exemplary gene or splice site sequence"
aauguaagca

SEQ ID NO: 5185 - RNA, 10 nt, Unknown
  source: /note="Description of Unknown: Exemplary gene or splice site sequence"
agaguaauug

SEQ ID NO: 5186 - RNA, 10 nt, Unknown
  source: /note="Description of Unknown: Exemplary gene or splice site sequence"
aggguugguu

SEQ ID NO: 5187 - RNA, 10 nt, Unknown
  source: /note="Description of Unknown: Exemplary gene or splice site sequence"
gugguaggag

SEQ ID NO: 5188 - RNA, 10 nt, Unknown
  source: /note="Description of Unknown: Exemplary gene or splice site sequence"
aaggcaguuu

SEQ ID NO: 5189 - RNA, 10 nt, Unknown
  source: /note="Description of Unknown: Exemplary gene or splice site sequence"
caaguaagcc

SEQ ID NO: 5190 - RNA, 10 nt, Unknown
  source: /note="Description of Unknown: Exemplary gene or splice site sequence"
cuggcaagua

SEQ ID NO: 5191 - RNA, 10 nt, Unknown
  source: /note="Description of Unknown: Exemplary gene or splice site sequence"
caggcaugau

SEQ ID NO: 5192 - RNA, 10 nt, Unknown
  source: /note="Description of Unknown: Exemplary gene or splice site sequence"
aggguaauug

SEQ ID NO: 5193 - RNA, 10 nt, Unknown
  source: /note="Description of Unknown: Exemplary gene or splice site sequence"
gggguaaccu

SEQ ID NO: 5194 - RNA, 10 nt, Unknown
  source: /note="Description of Unknown: Exemplary gene or splice site sequence"
aaaguaacua

SEQ ID NO: 5195 - RNA, 10 nt, Unknown
  source: /note="Description of Unknown: Exemplary gene or splice site sequence"
uaggucugcc

SEQ ID NO: 5196 - RNA, 10 nt, Unknown
  source: /note="Description of Unknown: Exemplary gene or splice site sequence"
acgguaugaa

SEQ ID NO: 5197 - RNA, 10 nt, Unknown
  source: /note="Description of Unknown: Exemplary gene or splice site sequence"
aguguauggg

SEQ ID NO: 5198 - RNA, 10 nt, Unknown
  source: /note="Description of Unknown: Exemplary gene or splice site sequence"
uggguuggca

SEQ ID NO: 5199 - RNA, 10 nt, Unknown
  source: /note="Description of Unknown: Exemplary gene or splice site sequence"
uagguaaacu

SEQ ID NO: 5200 - RNA, 10 nt, Unknown
  source: /note="Description of Unknown: Exemplary gene or splice site sequence"
agagugggua

SEQ ID NO: 5201 - RNA, 10 nt, Unknown
  source: /note="Description of Unknown: Exemplary gene or splice site sequence"
agaguauuug

SEQ ID NO: 5202 - RNA, 10 nt, Unknown
  source: /note="Description of Unknown: Exemplary gene or splice site sequence"
aguguaggaa

SEQ ID NO: 5203 - RNA, 10 nt, Unknown
  source: /note="Description of Unknown: Exemplary gene or splice site sequence"
cuuguacgua

SEQ ID NO: 5204 - RNA, 10 nt, Unknown
  source: /note="Description of Unknown: Exemplary gene or splice site sequence"
gaugugagau

SEQ ID NO: 5205 - RNA, 10 nt, Unknown
  source: /note="Description of Unknown: Exemplary gene or splice site sequence"
caggcagcca

SEQ ID NO: 5206 - RNA, 10 nt, Unknown
  source: /note="Description of Unknown: Exemplary gene or splice site sequence"
aaggucacug

SEQ ID NO: 5207 - RNA, 10 nt, Unknown
  source: /note="Description of Unknown: Exemplary gene or splice site sequence"
aaggucugac

SEQ ID NO: 5208 - RNA, 10 nt, Unknown
  source: /note="Description of Unknown: Exemplary gene or splice site sequence"
uagguuccuu

SEQ ID NO: 5209 - RNA, 10 nt, Unknown
  source: /note="Description of Unknown: Exemplary gene or splice site sequence"
cuggugcuuu

SEQ ID NO: 5210 - RNA, 10 nt, Unknown
  source: /note="Description of Unknown: Exemplary gene or splice site sequence"
ugaguuggug

SEQ ID NO: 5211 - RNA, 10 nt, Unknown
  source: /note="Description of Unknown: Exemplary gene or splice site sequence"
uuggugggau

SEQ ID NO: 5212 - RNA, 10 nt, Unknown
  source: /note="Description of Unknown: Exemplary gene or splice site sequence"
ugaguagggu

SEQ ID NO: 5213 - RNA, 10 nt, Unknown
  source: /note="Description of Unknown: Exemplary gene or splice site sequence"
ucggugaggu

SEQ ID NO: 5214 - RNA, 10 nt, Unknown
  source: /note="Description of Unknown: Exemplary gene or splice site sequence"
aaaguaaaga

SEQ ID NO: 5215 - RNA, 10 nt, Unknown
  source: /note="Description of Unknown: Exemplary gene or splice site sequence"
aaggcaaguc

SEQ ID NO: 5216 - RNA, 10 nt, Unknown
  source: /note="Description of Unknown: Exemplary gene or splice site sequence"
cggguaaagc

SEQ ID NO: 5217 - RNA, 10 nt, Unknown
  source: /note="Description of Unknown: Exemplary gene or splice site sequence"
aaaguuaguu

SEQ ID NO: 5218 - RNA, 10 nt, Unknown
  source: /note="Description of Unknown: Exemplary gene or splice site sequence"
uuaguaagca

SEQ ID NO: 5219 - RNA, 10 nt, Unknown
  source: /note="Description of Unknown: Exemplary gene or splice site sequence"
gaggucacau

SEQ ID NO: 5220 - RNA, 10 nt, Unknown
  source: /note="Description of Unknown: Exemplary gene or splice site sequence"
uaagugguau

SEQ ID NO: 5221 - RNA, 10 nt, Unknown
  source: /note="Description of Unknown: Exemplary gene or splice site sequence"
uaggugcuuu

SEQ ID NO: 5222 - RNA, 10 nt, Unknown
  source: /note="Description of Unknown: Exemplary gene or splice site sequence"
ggaguaggca

SEQ ID NO: 5223 - RNA, 10 nt, Unknown
  source: /note="Description of Unknown: Exemplary gene or splice site sequence"
ugaguaagga

SEQ ID NO: 5224 - RNA, 10 nt, Unknown
  source: /note="Description of Unknown: Exemplary gene or splice site sequence"
cagguggagc

SEQ ID NO: 5225 - RNA, 10 nt, Unknown
  source: /note="Description of Unknown: Exemplary gene or splice site sequence"
gauguagaag

SEQ ID NO: 5226 - RNA, 10 nt, Unknown
  source: /note="Description of Unknown: Exemplary gene or splice site sequence"
aaugccugcc

SEQ ID NO: 5227 - RNA, 10 nt, Unknown
  source: /note="Description of Unknown: Exemplary gene or splice site sequence"
augguaaggc

SEQ ID NO: 5228 - RNA, 10 nt, Unknown
  source: /note="Description of Unknown: Exemplary gene or splice site sequence"
uggguaauau

SEQ ID NO: 5229 - RNA, 10 nt, Unknown
  source: /note="Description of Unknown: Exemplary gene or splice site sequence"
cugguaccuc

SEQ ID NO: 5230 - RNA, 10 nt, Unknown
  source: /note="Description of Unknown: Exemplary gene or splice site sequence"
cacgugagcc

SEQ ID NO: 5231 - RNA, 10 nt, Unknown
  source: /note="Description of Unknown: Exemplary gene or splice site sequence"
ugaguuugug

SEQ ID NO: 5232 - RNA, 10 nt, Unknown
  source: /note="Description of Unknown: Exemplary gene or splice site sequence"
ccgguagugu

SEQ ID NO: 5233 - RNA, 10 nt, Unknown
  source: /note="Description of Unknown: Exemplary gene or splice site sequence"
aaagugacaa

SEQ ID NO: 5234 - RNA, 10 nt, Unknown
  source: /note="Description of Unknown: Exemplary gene or splice site sequence"
gaaguggguu

SEQ ID NO: 5235 - RNA, 10 nt, Unknown
  source: /note="Description of Unknown: Exemplary gene or splice site sequence"
caggugcagc

SEQ ID NO: 5236 - RNA, 10 nt, Unknown
  source: /note="Description of Unknown: Exemplary gene or splice site sequence"
gaggugggcc

SEQ ID NO: 5237 - RNA, 10 nt, Unknown
  source: /note="Description of Unknown: Exemplary gene or splice site sequence"
uaugugcguc

SEQ ID NO: 5238 - RNA, 10 nt, Unknown
  source: /note="Description of Unknown: Exemplary gene or splice site sequence"
gggguacugg

SEQ ID NO: 5239 - RNA, 10 nt, Unknown
  source: /note="Description of Unknown: Exemplary gene or splice site sequence"
cugguagguu

SEQ ID NO: 5240 - RNA, 10 nt, Unknown
  source: /note="Description of Unknown: Exemplary gene or splice site sequence"
uuggcauguu

SEQ ID NO: 5241 - RNA, 10 nt, Unknown
  source: /note="Description of Unknown: Exemplary gene or splice site sequence"
aauguaauac

SEQ ID NO: 5242 - RNA, 10 nt, Unknown
  source: /note="Description of Unknown: Exemplary gene or splice site sequence"
uaggccggug

SEQ ID NO: 5243 - RNA, 10 nt, Unknown
  source: /note="Description of Unknown: Exemplary gene or splice site sequence"
agagucagua

SEQ ID NO: 5244 - RNA, 10 nt, Unknown
  source: /note="Description of Unknown: Exemplary gene or splice site sequence"
uaaguaaauc

SEQ ID NO: 5245 - RNA, 10 nt, Unknown
  source: /note="Description of Unknown: Exemplary gene or splice site sequence"
cagguuccuc

SEQ ID NO: 5246 - RNA, 10 nt, Unknown
  source: /note="Description of Unknown: Exemplary gene or splice site sequence"
uagguacgau

SEQ ID NO: 5247 - RNA, 10 nt, Unknown
  source: /note="Description of Unknown: Exemplary gene or splice site sequence"
agaguuagug

SEQ ID NO: 5248 - RNA, 10 nt, Unknown
  source: /note="Description of Unknown: Exemplary gene or splice site sequence"
gcaguaagug

SEQ ID NO: 5249 - RNA, 10 nt, Unknown
  source: /note="Description of Unknown: Exemplary gene or splice site sequence"
agggugguag

SEQ ID NO: 5250 - RNA, 10 nt, Unknown
  source: /note="Description of Unknown: Exemplary gene or splice site sequence"
ggaguaaugu

SEQ ID NO: 5251 - RNA, 10 nt, Unknown
  source: /note="Description of Unknown: Exemplary gene or splice site sequence"
gauguaaguc

SEQ ID NO: 5252 - RNA, 10 nt, Unknown
  source: /note="Description of Unknown: Exemplary gene or splice site sequence"
ccaguuucgu

SEQ ID NO: 5253 - RNA, 10 nt, Unknown
  source: /note="Description of Unknown: Exemplary gene or splice site sequence"
aagguucggg

SEQ ID NO: 5254 - RNA, 10 nt, Unknown
  source: /note="Description of Unknown: Exemplary gene or splice site sequence"
augguggagu

SEQ ID NO: 5255 - RNA, 10 nt, Unknown
  source: /note="Description of Unknown: Exemplary gene or splice site sequence"
aagguaccgg

SEQ ID NO: 5256 - RNA, 10 nt, Unknown
  source: /note="Description of Unknown: Exemplary gene or splice site sequence"
gaagugcgaa

SEQ ID NO: 5257 - RNA, 10 nt, Unknown
  source: /note="Description of Unknown: Exemplary gene or splice site sequence"
ugggucaguu

SEQ ID NO: 5258 - RNA, 10 nt, Unknown
  source: /note="Description of Unknown: Exemplary gene or splice site sequence"
aagguguaga

SEQ ID NO: 5259 - RNA, 10 nt, Unknown
  source: /note="Description of Unknown: Exemplary gene or splice site sequence"
uggguaggcc

SEQ ID NO: 5260 - RNA, 10 nt, Unknown
  source: /note="Description of Unknown: Exemplary gene or splice site sequence"
ccagugaguc

SEQ ID NO: 5261 - RNA, 10 nt, Unknown
  source: /note="Description of Unknown: Exemplary gene or splice site sequence"
aaggucacuu

SEQ ID NO: 5262 - RNA, 10 nt, Unknown
  source: /note="Description of Unknown: Exemplary gene or splice site sequence"
agcgugaggc

SEQ ID NO: 5263 - RNA, 10 nt, Unknown
  source: /note="Description of Unknown: Exemplary gene or splice site sequence"
uccgugguaa

SEQ ID NO: 5264 - RNA, 10 nt, Unknown
  source: /note="Description of Unknown: Exemplary gene or splice site sequence"
agaguacuua

SEQ ID NO: 5265 - RNA, 10 nt, Unknown
  source: /note="Description of Unknown: Exemplary gene or splice site sequence"
ggggucagau

SEQ ID NO: 5266 - RNA, 10 nt, Unknown
  source: /note="Description of Unknown: Exemplary gene or splice site sequence"
aagguggacc

SEQ ID NO: 5267 - RNA, 10 nt, Unknown
  source: /note="Description of Unknown: Exemplary gene or splice site sequence"
agagugagcg

SEQ ID NO: 5268 - RNA, 10 nt, Unknown
  source: /note="Description of Unknown: Exemplary gene or splice site sequence"
agagucagau

SEQ ID NO: 5269 - RNA, 10 nt, Unknown
  source: /note="Description of Unknown: Exemplary gene or splice site sequence"
uaaguauuac

SEQ ID NO: 5270 - RNA, 10 nt, Unknown
  source: /note="Description of Unknown: Exemplary gene or splice site sequence"
agaguauuuc

SEQ ID NO: 5271 - RNA, 10 nt, Unknown
  source: /note="Description of Unknown: Exemplary gene or splice site sequence"
agaguucagc

SEQ ID NO: 5272 - RNA, 10 nt, Unknown
  source: /note="Description of Unknown: Exemplary gene or splice site sequence"
auggugaagu

SEQ ID NO: 5273 - RNA, 10 nt, Unknown
  source: /note="Description of Unknown: Exemplary gene or splice site sequence"
uaggugaucc

SEQ ID NO: 5274 - RNA, 10 nt, Unknown
  source: /note="Description of Unknown: Exemplary gene or splice site sequence"
ggaguaagau

SEQ ID NO: 5275 - RNA, 10 nt, Unknown
  source: /note="Description of Unknown: Exemplary gene or splice site sequence"
uagguaccaa

SEQ ID NO: 5276 - RNA, 10 nt, Unknown
  source: /note="Description of Unknown: Exemplary gene or splice site sequence"
agaguugguc

SEQ ID NO: 5277 - RNA, 10 nt, Unknown
  source: /note="Description of Unknown: Exemplary gene or splice site sequence"
gaagugagac

SEQ ID NO: 5278 - RNA, 10 nt, Unknown
  source: /note="Description of Unknown: Exemplary gene or splice site sequence"
aucguagguu

SEQ ID NO: 5279 - RNA, 10 nt, Unknown
  source: /note="Description of Unknown: Exemplary gene or splice site sequence"
gagguacgcu

SEQ ID NO: 5280 - RNA, 10 nt, Unknown
  source: /note="Description of Unknown: Exemplary gene or splice site sequence"
acgguaaggg

SEQ ID NO: 5281 - RNA, 10 nt, Unknown
  source: /note="Description of Unknown: Exemplary gene or splice site sequence"
caggcauguc

SEQ ID NO: 5282 - RNA, 10 nt, Unknown
  source: /note="Description of Unknown: Exemplary gene or splice site sequence"
uuaguaagau

SEQ ID NO: 5283 - RNA, 10 nt, Unknown
  source: /note="Description of Unknown: Exemplary gene or splice site sequence"
ugaguagguu

SEQ ID NO: 5284 - RNA, 10 nt, Unknown
  source: /note="Description of Unknown: Exemplary gene or splice site sequence"
aggguacgaa

SEQ ID NO: 5285 - RNA, 10 nt, Unknown
  source: /note="Description of Unknown: Exemplary gene or splice site sequence"
acgguauguu

SEQ ID NO: 5286 - RNA, 10 nt, Unknown
  source: /note="Description of Unknown: Exemplary gene or splice site sequence"
aggguacugu

SEQ ID NO: 5287 - RNA, 10 nt, Unknown
  source: /note="Description of Unknown: Exemplary gene or splice site sequence"
uugguaugga

SEQ ID NO: 5288 - RNA, 10 nt, Unknown
  source: /note="Description of Unknown: Exemplary gene or splice site sequence"
uaaguaacug

SEQ ID NO: 5289 - RNA, 10 nt, Unknown
  source: /note="Description of Unknown: Exemplary gene or splice site sequence"
gcggucagcc

SEQ ID NO: 5290 - RNA, 10 nt, Unknown
  source: /note="Description of Unknown: Exemplary gene or splice site sequence"
uuugugaguc

SEQ ID NO: 5291 - RNA, 10 nt, Unknown
  source: /note="Description of Unknown: Exemplary gene or splice site sequence"
guggucagug

SEQ ID NO: 5292 - RNA, 10 nt, Unknown
  source: /note="Description of Unknown: Exemplary gene or splice site sequence"
cuggucugua

SEQ ID NO: 5293 - RNA, 10 nt, Unknown
  source: /note="Description of Unknown: Exemplary gene or splice site sequence"
gagguucuua

SEQ ID NO: 5294 - RNA, 10 nt, Unknown
  source: /note="Description of Unknown: Exemplary gene or splice site sequence"
augguacuga

SEQ ID NO: 5295 - RNA, 10 nt, Unknown
  source: /note="Description of Unknown: Exemplary gene or splice site sequence"
aaugugcuuu

SEQ ID NO: 5296 - RNA, 10 nt, Unknown
  source: /note="Description of Unknown: Exemplary gene or splice site sequence"
aggguggcgu

SEQ ID NO: 5297 - RNA, 10 nt, Unknown
  source: /note="Description of Unknown: Exemplary gene or splice site sequence"
ccggcaggaa

SEQ ID NO: 5298 - RNA, 10 nt, Unknown
  source: /note="Description of Unknown: Exemplary gene or splice site sequence"
cauguggguc

SEQ ID NO: 5299 - RNA, 10 nt, Unknown
  source: /note="Description of Unknown: Exemplary gene or splice site sequence"
uugguuuguu

SEQ ID NO: 5300 - RNA, 10 nt, Unknown
  source: /note="Description of Unknown: Exemplary gene or splice site sequence"
cagguucugu

SEQ ID NO: 5301 - RNA, 10 nt, Unknown
  source: /note="Description of Unknown: Exemplary gene or splice site sequence"
acgguaagcg

SEQ ID NO: 5302 - RNA, 10 nt, Unknown
  source: /note="Description of Unknown: Exemplary gene or splice site sequence"
cuggucagua

SEQ ID NO: 5303 - RNA, 10 nt, Unknown
  source: /note="Description of Unknown: Exemplary gene or splice site sequence"
ucaguaggcu

SEQ ID NO: 5304 - RNA, 10 nt, Unknown
  source: /note="Description of Unknown: Exemplary gene or splice site sequence"
ugaguaggac

SEQ ID NO: 5305 - RNA, 10 nt, Unknown
  source: /note="Description of Unknown: Exemplary gene or splice site sequence"
cagguuuuaa

SEQ ID NO: 5306 - RNA, 10 nt, Unknown
  source: /note="Description of Unknown: Exemplary gene or splice site sequence"
gagguguccc

SEQ ID NO: 5307 - RNA, 10 nt, Unknown
  source: /note="Description of Unknown: Exemplary gene or splice site sequence"
aggguggguu

SEQ ID NO: 5308 - RNA, 10 nt, Unknown
  source: /note="Description of Unknown: Exemplary gene or splice site sequence"
guggugagac

SEQ ID NO: 5309 - RNA, 10 nt, Unknown
  source: /note="Description of Unknown: Exemplary gene or splice site sequence"
cacguaggga

SEQ ID NO: 5310 - RNA, 10 nt, Unknown
  source: /note="Description of Unknown: Exemplary gene or splice site sequence"
gugguauuuu

SEQ ID NO: 5311 - RNA, 10 nt, Unknown
  source: /note="Description of Unknown: Exemplary gene or splice site sequence"
gagauauccu

SEQ ID NO: 5312 - RNA, 10 nt, Unknown
  source: /note="Description of Unknown: Exemplary gene or splice site sequence"
aaggugaaca

SEQ ID NO: 5313 - RNA, 10 nt, Unknown
  source: /note="Description of Unknown: Exemplary gene or splice site sequence"
uaaguagggc

SEQ ID NO: 5314 - RNA, 10 nt, Unknown
  source: /note="Description of Unknown: Exemplary gene or splice site sequence"
cuggugcggg

SEQ ID NO: 5315 - RNA, 10 nt, Unknown
  source: /note="Description of Unknown: Exemplary gene or splice site sequence"
cuggucaaua

SEQ ID NO: 5316 - RNA, 10 nt, Unknown
  source: /note="Description of Unknown: Exemplary gene or splice site sequence"
agaguaaaaa

SEQ ID NO: 5317 - RNA, 10 nt, Unknown
  source: /note="Description of Unknown: Exemplary gene or splice site sequence"
aaggugcagu

SEQ ID NO: 5318 - RNA, 10 nt, Unknown
  source: /note="Description of Unknown: Exemplary gene or splice site sequence"
cggguaagca

SEQ ID NO: 5319 - RNA, 10 nt, Unknown
  source: /note="Description of Unknown: Exemplary gene or splice site sequence"
aaagugagcc

SEQ ID NO: 5320 - RNA, 10 nt, Unknown
  source: /note="Description of Unknown: Exemplary gene or splice site sequence"
augguaauca

SEQ ID NO: 5321 - RNA, 10 nt, Unknown
  source: /note="Description of Unknown: Exemplary gene or splice site sequence"
gcaguacgug

SEQ ID NO: 5322 - RNA, 10 nt, Unknown
  source: /note="Description of Unknown: Exemplary gene or splice site sequence"
augguacaug

SEQ ID NO: 5323 - RNA, 10 nt, Unknown
  source: /note="Description of Unknown: Exemplary gene or splice site sequence"
aagguuaaga

SEQ ID NO: 5324 - RNA, 10 nt, Unknown
  source: /note="Description of Unknown: Exemplary gene or splice site sequence"
cggguaaaug

SEQ ID NO: 5325 - RNA, 10 nt, Unknown
  source: /note="Description of Unknown: Exemplary gene or splice site sequence"
gagguucgca

SEQ ID NO: 5326 - RNA, 10 nt, Unknown
  source: /note="Description of Unknown: Exemplary gene or splice site sequence"
gaggcucugg

SEQ ID NO: 5327 - RNA, 10 nt, Unknown
  source: /note="Description of Unknown: Exemplary gene or splice site sequence"
auggugggac

SEQ ID NO: 5328 - RNA, 10 nt, Unknown
  source: /note="Description of Unknown: Exemplary gene or splice site sequence"
aacgugguag

SEQ ID NO: 5329 - RNA, 10 nt, Unknown
  source: /note="Description of Unknown: Exemplary gene or splice site sequence"
aaggugauag

SEQ ID NO: 5330 - RNA, 10 nt, Unknown
  source: /note="Description of Unknown: Exemplary gene or splice site sequence"
gggguuugca

SEQ ID NO: 5331 - RNA, 10 nt, Unknown
  source: /note="Description of Unknown: Exemplary gene or splice site sequence"
cauguaaggg

SEQ ID NO: 5332 - RNA, 10 nt, Unknown
  source: /note="Description of Unknown: Exemplary gene or splice site sequence"
ucaguugagu

SEQ ID NO: 5333 - RNA, 10 nt, Unknown
  source: /note="Description of Unknown: Exemplary gene or splice site sequence"
aaagugcggc

SEQ ID NO: 5334 - RNA, 10 nt, Unknown
  source: /note="Description of Unknown: Exemplary gene or splice site sequence"
agagugagcc

SEQ ID NO: 5335 - RNA, 10 nt, Unknown
  source: /note="Description of Unknown: Exemplary gene or splice site sequence"
auggcaagaa

SEQ ID NO: 5336 - RNA, 10 nt, Unknown
  source: /note="Description of Unknown: Exemplary gene or splice site sequence"
acaguaaggu

SEQ ID NO: 5337 - RNA, 10 nt, Unknown
  source: /note="Description of Unknown: Exemplary gene or splice site sequence"
aaggucucua

SEQ ID NO: 5338 - RNA, 10 nt, Unknown
  source: /note="Description of Unknown: Exemplary gene or splice site sequence"
gugguaaaaa

SEQ ID NO: 5339 - RNA, 10 nt, Unknown
  source: /note="Description of Unknown: Exemplary gene or splice site sequence"
aaaguaggug

SEQ ID NO: 5340 - RNA, 10 nt, Unknown
  source: /note="Description of Unknown: Exemplary gene or splice site sequence"
uaggugcacu

SEQ ID NO: 5341 - RNA, 10 nt, Unknown
  source: /note="Description of Unknown: Exemplary gene or splice site sequence"
gucgugguau

SEQ ID NO: 5342 - RNA, 10 nt, Unknown
  source: /note="Description of Unknown: Exemplary gene or splice site sequence"
cagguauagg

SEQ ID NO: 5343 - RNA, 10 nt, Unknown
  source: /note="Description of Unknown: Exemplary gene or splice site sequence"
ugagugagag

SEQ ID NO: 5344 - RNA, 10 nt, Unknown
  source: /note="Description of Unknown: Exemplary gene or splice site sequence"
acugugagcc

SEQ ID NO: 5345 - RNA, 10 nt, Unknown
  source: /note="Description of Unknown: Exemplary gene or splice site sequence"
aucguuaguu

SEQ ID NO: 5346 - RNA, 10 nt, Unknown
  source: /note="Description of Unknown: Exemplary gene or splice site sequence"
uuuguaccaa

SEQ ID NO: 5347 - RNA, 10 nt, Unknown
  source: /note="Description of Unknown: Exemplary gene or splice site sequence"
ugggugagau

SEQ ID NO: 5348 - RNA, 10 nt, Unknown
  source: /note="Description of Unknown: Exemplary gene or splice site sequence"
agagugagaa

SEQ ID NO: 5349 - RNA, 10 nt, Unknown
  source: /note="Description of Unknown: Exemplary gene or splice site sequence"
agaguagggg

SEQ ID NO: 5350 - RNA, 10 nt, Unknown
  source: /note="Description of Unknown: Exemplary gene or splice site sequence"
agggcaagua

SEQ ID NO: 5351 - RNA, 10 nt, Unknown
  source: /note="Description of Unknown: Exemplary gene or splice site sequence"
cgggucagua

SEQ ID NO: 5352 - RNA, 10 nt, Unknown
  source: /note="Description of Unknown: Exemplary gene or splice site sequence"
uugguaugcc

SEQ ID NO: 5353 - RNA, 10 nt, Unknown
  source: /note="Description of Unknown: Exemplary gene or splice site sequence"
cggguuagau

SEQ ID NO: 5354 - RNA, 10 nt, Unknown
  source: /note="Description of Unknown: Exemplary gene or splice site sequence"
ggggugaagu

SEQ ID NO: 5355 - RNA, 10 nt, Unknown
  source: /note="Description of Unknown: Exemplary gene or splice site sequence"
cccgugugaa

SEQ ID NO: 5356 - RNA, 10 nt, Unknown
  source: /note="Description of Unknown: Exemplary gene or splice site sequence"
gcaguuugga

SEQ ID NO: 5357 - RNA, 10 nt, Unknown
  source: /note="Description of Unknown: Exemplary gene or splice site sequence"
ugcguaagac

SEQ ID NO: 5358 - RNA, 10 nt, Unknown
  source: /note="Description of Unknown: Exemplary gene or splice site sequence"
agagucugua

SEQ ID NO: 5359 - RNA, 10 nt, Unknown
  source: /note="Description of Unknown: Exemplary gene or splice site sequence"
cacgugagca

SEQ ID NO: 5360 - RNA, 10 nt, Unknown
  source: /note="Description of Unknown: Exemplary gene or splice site sequence"
aggguaaaag

SEQ ID NO: 5361 - RNA, 10 nt, Unknown
  source: /note="Description of Unknown: Exemplary gene or splice site sequence"
caggcugggu

SEQ ID NO: 5362 - RNA, 10 nt, Unknown
  source: /note="Description of Unknown: Exemplary gene or splice site sequence"
gaagucuuca

SEQ ID NO: 5363 - RNA, 10 nt, Unknown
  source: /note="Description of Unknown: Exemplary gene or splice site sequence"
aaggcaaaaa

SEQ ID NO: 5364 - RNA, 10 nt, Unknown
  source: /note="Description of Unknown: Exemplary gene or splice site sequence"
guaguaaaua

SEQ ID NO: 5365 - RNA, 10 nt, Unknown
  source: /note="Description of Unknown: Exemplary gene or splice site sequence"
cuagugagag

SEQ ID NO: 5366 - RNA, 10 nt, Unknown
  source: /note="Description of Unknown: Exemplary gene or splice site sequence"
gaaguuucug

SEQ ID NO: 5367 - RNA, 10 nt, Unknown
  source: /note="Description of Unknown: Exemplary gene or splice site sequence"
ccuguacgua

SEQ ID NO: 5368 - RNA, 10 nt, Unknown
  source: /note="Description of Unknown: Exemplary gene or splice site sequence"
gaggugcgcg

SEQ ID NO: 5369 - RNA, 10 nt, Unknown
  source: /note="Description of Unknown: Exemplary gene or splice site sequence"
aagguguaaa

SEQ ID NO: 5370 - RNA, 10 nt, Unknown
  source: /note="Description of Unknown: Exemplary gene or splice site sequence"
ccaguauguu

SEQ ID NO: 5371 - RNA, 10 nt, Unknown
  source: /note="Description of Unknown: Exemplary gene or splice site sequence"
ccggucagcu

SEQ ID NO: 5372 - RNA, 10 nt, Unknown
  source: /note="Description of Unknown: Exemplary gene or splice site sequence"
augguuccug

SEQ ID NO: 5373 - RNA, 10 nt, Unknown
  source: /note="Description of Unknown: Exemplary gene or splice site sequence"
caaguuaaau

SEQ ID NO: 5374 - RNA, 10 nt, Unknown
  source: /note="Description of Unknown: Exemplary gene or splice site sequence"
agaguaggcu

SEQ ID NO: 5375 - RNA, 10 nt, Unknown
  source: /note="Description of Unknown: Exemplary gene or splice site sequence"
auggugggca

SEQ ID NO: 5376 - RNA, 10 nt, Unknown
  source: /note="Description of Unknown: Exemplary gene or splice site sequence"
ggaguaagac

SEQ ID NO: 5377 - RNA, 10 nt, Unknown
  source: /note="Description of Unknown: Exemplary gene or splice site sequence"
agggucacga

SEQ ID NO: 5378 - RNA, 10 nt, Unknown
  source: /note="Description of Unknown: Exemplary gene or splice site sequence"
uaggugauau

SEQ ID NO: 5379 - RNA, 10 nt, Unknown
  source: /note="Description of Unknown: Exemplary gene or splice site sequence"
gaaguaaguc

SEQ ID NO: 5380 - RNA, 10 nt, Unknown
  source: /note="Description of Unknown: Exemplary gene or splice site sequence"
cggguaagau

SEQ ID NO: 5381 - RNA, 10 nt, Unknown
  source: /note="Description of Unknown: Exemplary gene or splice site sequence"
caaguagcua

SEQ ID NO: 5382 - RNA, 10 nt, Unknown
  source: /note="Description of Unknown: Exemplary gene or splice site sequence"
ugaguaaaau

SEQ ID NO: 5383 - RNA, 10 nt, Unknown
  source: /note="Description of Unknown: Exemplary gene or splice site sequence"
gucguacgug

SEQ ID NO: 5384 - RNA, 10 nt, Unknown
  source: /note="Description of Unknown: Exemplary gene or splice site sequence"
augguacgua

SEQ ID NO: 5385 - RNA, 10 nt, Unknown
  source: /note="Description of Unknown: Exemplary gene or splice site sequence"
caggucucgg

SEQ ID NO: 5386 - RNA, 10 nt, Unknown
  source: /note="Description of Unknown: Exemplary gene or splice site sequence"
gaggcauguc

SEQ ID NO: 5387 - RNA, 10 nt, Unknown
  source: /note="Description of Unknown: Exemplary gene or splice site sequence"
agagugggau

SEQ ID NO: 5388 - RNA, 10 nt, Unknown
  source: /note="Description of Unknown: Exemplary gene or splice site sequence"
gugguuagag

SEQ ID NO: 5389 - RNA, 10 nt, Unknown
  source: /note="Description of Unknown: Exemplary gene or splice site sequence"
ugggugguga

SEQ ID NO: 5390 - RNA, 10 nt, Unknown
  source: /note="Description of Unknown: Exemplary gene or splice site sequence"
aagguuaaac

SEQ ID NO: 5391 - RNA, 10 nt, Unknown
  source: /note="Description of Unknown: Exemplary gene or splice site sequence"
cuuguuagcu

SEQ ID NO: 5392 - RNA, 10 nt, Unknown
  source: /note="Description of Unknown: Exemplary gene or splice site sequence"
aaaguaggaa

SEQ ID NO: 5393 - RNA, 10 nt, Unknown
  source: /note="Description of Unknown: Exemplary gene or splice site sequence"
uagguuguau

SEQ ID NO: 5394 - RNA, 10 nt, Unknown
  source: /note="Description of Unknown: Exemplary gene or splice site sequence"
agggugcgcc

SEQ ID NO: 5395 - RNA, 10 nt, Unknown
  source: /note="Description of Unknown: Exemplary gene or splice site sequence"
aaggugggcu

SEQ ID NO: 5396 - RNA, 10 nt, Unknown
  source: /note="Description of Unknown: Exemplary gene or splice site sequence"
uaaguaucug

SEQ ID NO: 5397 - RNA, 10 nt, Unknown
  source: /note="Description of Unknown: Exemplary gene or splice site sequence"
aagguaacgu

SEQ ID NO: 5398 - RNA, 10 nt, Unknown
  source: /note="Description of Unknown: Exemplary gene or splice site sequence"
augguggggc

SEQ ID NO: 5399 - RNA, 10 nt, Unknown
  source: /note="Description of Unknown: Exemplary gene or splice site sequence"
caaguacacg

SEQ ID NO: 5400 - RNA, 10 nt, Unknown
  source: /note="Description of Unknown: Exemplary gene or splice site sequence"
ggcguaagug

SEQ ID NO: 5401 - RNA, 10 nt, Unknown
  source: /note="Description of Unknown: Exemplary gene or splice site sequence"
auaguaggac

SEQ ID NO: 5402 - RNA, 10 nt, Unknown
  source: /note="Description of Unknown: Exemplary gene or splice site sequence"
agagugaggu

SEQ ID NO: 5403 - RNA, 10 nt, Unknown
  source: /note="Description of Unknown: Exemplary gene or splice site sequence"
uuuguaaaaa

SEQ ID NO: 5404 - RNA, 10 nt, Unknown
  source: /note="Description of Unknown: Exemplary gene or splice site sequence"
gaaguuugua

SEQ ID NO: 5405 - RNA, 10 nt, Unknown
  source: /note="Description of Unknown: Exemplary gene or splice site sequence"
cuaguaaucu

SEQ ID NO: 5406 - RNA, 10 nt, Unknown
  source: /note="Description of Unknown: Exemplary gene or splice site sequence"
aagguuuuua

SEQ ID NO: 5407 - RNA, 10 nt, Unknown
  source: /note="Description of Unknown: Exemplary gene or splice site sequence"
gaggugcguu

SEQ ID NO: 5408 - RNA, 10 nt, Unknown
  source: /note="Description of Unknown: Exemplary gene or splice site sequence"
uaggcgagua

SEQ ID NO: 5409 - RNA, 10 nt, Unknown
  source: /note="Description of Unknown: Exemplary gene or splice site sequence"
accgugagua

SEQ ID NO: 5410 - RNA, 10 nt, Unknown
  source: /note="Description of Unknown: Exemplary gene or splice site sequence"
caggucccga

SEQ ID NO: 5411 - RNA, 10 nt, Unknown
  source: /note="Description of Unknown: Exemplary gene or splice site sequence"
augguacugg

SEQ ID NO: 5412 - RNA, 10 nt, Unknown
  source: /note="Description of Unknown: Exemplary gene or splice site sequence"
ugaguucagu

SEQ ID NO: 5413 - RNA, 10 nt, Unknown
  source: /note="Description of Unknown: Exemplary gene or splice site sequence"
aauguguggu

SEQ ID NO: 5414 - RNA, 10 nt, Unknown
  source: /note="Description of Unknown: Exemplary gene or splice site sequence"
uccguugguu

SEQ ID NO: 5415 - RNA, 10 nt, Unknown
  source: /note="Description of Unknown: Exemplary gene or splice site sequence"
caggucagag

SEQ ID NO: 5416 - RNA, 10 nt, Unknown
  source: /note="Description of Unknown: Exemplary gene or splice site sequence"
caggucccua

SEQ ID NO: 5417 - RNA, 10 nt, Unknown
  source: /note="Description of Unknown: Exemplary gene or splice site sequence"
uagguagacu

SEQ ID NO: 5418 - RNA, 10 nt, Unknown
  source: /note="Description of Unknown: Exemplary gene or splice site sequence"
caaguuaagg

SEQ ID NO: 5419 - RNA, 10 nt, Unknown
  source: /note="Description of Unknown: Exemplary gene or splice site sequence"
gaggugugcg

SEQ ID NO: 5420 - RNA, 10 nt, Unknown
  source: /note="Description of Unknown: Exemplary gene or splice site sequence"
gaagcugccc

SEQ ID NO: 5421 - RNA, 10 nt, Unknown
  source: /note="Description of Unknown: Exemplary gene or splice site sequence"
cgaguacgug

SEQ ID NO: 5422 - RNA, 10 nt, Unknown
  source: /note="Description of Unknown: Exemplary gene or splice site sequence"
cggguaggua

SEQ ID NO: 5423 - RNA, 10 nt, Unknown
  source: /note="Description of Unknown: Exemplary gene or splice site sequence"
uugguauuga

SEQ ID NO: 5424 - RNA, 10 nt, Unknown
  source: /note="Description of Unknown: Exemplary gene or splice site sequence"
auuguaugau

SEQ ID NO: 5425 - RNA, 10 nt, Unknown
  source: /note="Description of Unknown: Exemplary gene or splice site sequence"
uugguaugaa

SEQ ID NO: 5426 - RNA, 10 nt, Unknown
  source: /note="Description of Unknown: Exemplary gene or splice site sequence"
gaggugguca

SEQ ID NO: 5427 - RNA, 10 nt, Unknown
  source: /note="Description of Unknown: Exemplary gene or splice site sequence"
gcuguaugaa

SEQ ID NO: 5428 - RNA, 10 nt, Unknown
  source: /note="Description of Unknown: Exemplary gene or splice site sequence"
cagguguugc

SEQ ID NO: 5429 - RNA, 10 nt, Unknown
  source: /note="Description of Unknown: Exemplary gene or splice site sequence"
cagguaaaac

SEQ ID NO: 5430 - RNA, 10 nt, Unknown
  source: /note="Description of Unknown: Exemplary gene or splice site sequence"
auaguaaggu

SEQ ID NO: 5431 - RNA, 10 nt, Unknown
  source: /note="Description of Unknown: Exemplary gene or splice site sequence"
cugguuagag

SEQ ID NO: 5432 - RNA, 10 nt, Unknown
  source: /note="Description of Unknown: Exemplary gene or splice site sequence"
agcgugugag

SEQ ID NO: 5433 - RNA, 10 nt, Unknown
  source: /note="Description of Unknown: Exemplary gene or splice site sequence"
aagguuaucu

SEQ ID NO: 5434 - RNA, 10 nt, Unknown
  source: /note="Description of Unknown: Exemplary gene or splice site sequence"
cacgugagua

SEQ ID NO: 5435 - RNA, 10 nt, Unknown
  source: /note="Description of Unknown: Exemplary gene or splice site sequence"
agggucagua

SEQ ID NO: 5436 - RNA, 10 nt, Unknown
  source: /note="Description of Unknown: Exemplary gene or splice site sequence"
gagguauaau

SEQ ID NO: 5437 - RNA, 10 nt, Unknown
  source: /note="Description of Unknown: Exemplary gene or splice site sequence"
cagguuauuu

SEQ ID NO: 5438 - RNA, 10 nt, Unknown
  source: /note="Description of Unknown: Exemplary gene or splice site sequence"
aggguggacu

SEQ ID NO: 5439 - RNA, 10 nt, Unknown
  source: /note="Description of Unknown: Exemplary gene or splice site sequence"
auuguaauuc

SEQ ID NO: 5440 - RNA, 10 nt, Unknown
  source: /note="Description of Unknown: Exemplary gene or splice site sequence"
uuuguggguu

SEQ ID NO: 5441 - RNA, 10 nt, Unknown
  source: /note="Description of Unknown: Exemplary gene or splice site sequence"
augguacgug

SEQ ID NO: 5442 - RNA, 10 nt, Unknown
  source: /note="Description of Unknown: Exemplary gene or splice site sequence"
aagguguucc

SEQ ID NO: 5443 - RNA, 10 nt, Unknown
  source: /note="Description of Unknown: Exemplary gene or splice site sequence"
caggugacgc

SEQ ID NO: 5444 - RNA, 10 nt, Unknown
  source: /note="Description of Unknown: Exemplary gene or splice site sequence"
gagguacuaa

SEQ ID NO: 5445 - RNA, 10 nt, Unknown
  source: /note="Description of Unknown: Exemplary gene or splice site sequence"
acaguucagu

SEQ ID NO: 5446 - RNA, 10 nt, Unknown
  source: /note="Description of Unknown: Exemplary gene or splice site sequence"
gaggucacgg

SEQ ID NO: 5447 - RNA, 10 nt, Unknown
  source: /note="Description of Unknown: Exemplary gene or splice site sequence"
caaguaaggc

SEQ ID NO: 5448 - RNA, 10 nt, Unknown
  source: /note="Description of Unknown: Exemplary gene or splice site sequence"
aagguuuggg

SEQ ID NO: 5449 - RNA, 10 nt, Unknown
  source: /note="Description of Unknown: Exemplary gene or splice site sequence"
aaagugggcu

SEQ ID NO: 5450 - RNA, 10 nt, Unknown
  source: /note="Description of Unknown: Exemplary gene or splice site sequence"
gcgguucuug

SEQ ID NO: 5451 - RNA, 10 nt, Unknown
  source: /note="Description of Unknown: Exemplary gene or splice site sequence"
gagguggagc

SEQ ID NO: 5452 - RNA, 10 nt, Unknown
  source: /note="Description of Unknown: Exemplary gene or splice site sequence"
ugagucagug

SEQ ID NO: 5453 - RNA, 10 nt, Unknown
  source: /note="Description of Unknown: Exemplary gene or splice site sequence"
caggucaagg

SEQ ID NO: 5454 - RNA, 10 nt, Unknown
  source: /note="Description of Unknown: Exemplary gene or splice site sequence"
aguguaagcu

SEQ ID NO: 5455 - RNA, 10 nt, Unknown
  source: /note="Description of Unknown: Exemplary gene or splice site sequence"
gaggcagaaa

SEQ ID NO: 5456 - RNA, 10 nt, Unknown
  source: /note="Description of Unknown: Exemplary gene or splice site sequence"
aaggucacac

SEQ ID NO: 5457 - RNA, 10 nt, Unknown
  source: /note="Description of Unknown: Exemplary gene or splice site sequence"
gaaguagguu

SEQ ID NO: 5458 - RNA, 10 nt, Unknown
  source: /note="Description of Unknown: Exemplary gene or splice site sequence"
gucguaaguu

SEQ ID NO: 5459 - RNA, 10 nt, Unknown
  source: /note="Description of Unknown: Exemplary gene or splice site sequence"
agaguaugca

SEQ ID NO: 5460 - RNA, 10 nt, Unknown
  source: /note="Description of Unknown: Exemplary gene or splice site sequence"
ccugugcaaa

SEQ ID NO: 5461 - RNA, 10 nt, Unknown
  source: /note="Description of Unknown: Exemplary gene or splice site sequence"
acggugaaaa

SEQ ID NO: 5462 - RNA, 10 nt, Unknown
  source: /note="Description of Unknown: Exemplary gene or splice site sequence"
cagguacgaa

SEQ ID NO: 5463 - RNA, 10 nt, Unknown
  source: /note="Description of Unknown: Exemplary gene or splice site sequence"
caugugagga

SEQ ID NO: 5464 - RNA, 10 nt, Unknown
  source: /note="Description of Unknown: Exemplary gene or splice site sequence"
agcgugagua

SEQ ID NO: 5465 - RNA, 10 nt, Unknown
  source: /note="Description of Unknown: Exemplary gene or splice site sequence"
gguguguagg

SEQ ID NO: 5466 - RNA, 10 nt, Unknown
  source: /note="Description of Unknown: Exemplary gene or splice site sequence"
aacgugagcu

SEQ ID NO: 5467 - RNA, 10 nt, Unknown
  source: /note="Description of Unknown: Exemplary gene or splice site sequence"
gaggugaacu

SEQ ID NO: 5468 - RNA, 10 nt, Unknown
  source: /note="Description of Unknown: Exemplary gene or splice site sequence"
agaguucagu

SEQ ID NO: 5469 - RNA, 10 nt, Unknown
  source: /note="Description of Unknown: Exemplary gene or splice site sequence"
aacgugugua

SEQ ID NO: 5470 - RNA, 10 nt, Unknown
  source: /note="Description of Unknown: Exemplary gene or splice site sequence"
cagguugugg

SEQ ID NO: 5471 - RNA, 10 nt, Unknown
  source: /note="Description of Unknown: Exemplary gene or splice site sequence"
aagguacuag

SEQ ID NO: 5472 - RNA, 10 nt, Unknown
  source: /note="Description of Unknown: Exemplary gene or splice site sequence"
ucagugaaaa

SEQ ID NO: 5473 - RNA, 10 nt, Unknown
  source: /note="Description of Unknown: Exemplary gene or splice site sequence"
aaugucuggu

SEQ ID NO: 5474 - RNA, 10 nt, Unknown
  source: /note="Description of Unknown: Exemplary gene or splice site sequence"
acgguaaaau

SEQ ID NO: 5475 - RNA, 10 nt, Unknown
  source: /note="Description of Unknown: Exemplary gene or splice site sequence"
cugguguaag

SEQ ID NO: 5476 - RNA, 10 nt, Unknown
  source: /note="Description of Unknown: Exemplary gene or splice site sequence"
gaggugcgaa

SEQ ID NO: 5477 - RNA, 10 nt, Unknown
  source: /note="Description of Unknown: Exemplary gene or splice site sequence"
aggguuucuc

SEQ ID NO: 5478 - RNA, 10 nt, Unknown
  source: /note="Description of Unknown: Exemplary gene or splice site sequence"
cagguagccc

SEQ ID NO: 5479 - RNA, 10 nt, Unknown
  source: /note="Description of Unknown: Exemplary gene or splice site sequence"
auuguauugg

SEQ ID NO: 5480 - RNA, 10 nt, Unknown
  source: /note="Description of Unknown: Exemplary gene or splice site sequence"
augguacuua

SEQ ID NO: 5481 - RNA, 10 nt, Unknown
  source: /note="Description of Unknown: Exemplary gene or splice site sequence"
gaggcccgac

SEQ ID NO: 5482 - RNA, 10 nt, Unknown
  source: /note="Description of Unknown: Exemplary gene or splice site sequence"
ucgguaagac

SEQ ID NO: 5483 - RNA, 10 nt, Unknown
  source: /note="Description of Unknown: Exemplary gene or splice site sequence"
cgggcuguag

SEQ ID NO: 5484 - RNA, 10 nt, Unknown
  source: /note="Description of Unknown: Exemplary gene or splice site sequence"
uaugugugug

SEQ ID NO: 5485 - RNA, 10 nt, Unknown
  source: /note="Description of Unknown: Exemplary gene or splice site sequence"
uagguagaaa

SEQ ID NO: 5486 - RNA, 10 nt, Unknown
  source: /note="Description of Unknown: Exemplary gene or splice site sequence"
guggucauua

SEQ ID NO: 5487 - RNA, 10 nt, Unknown
  source: /note="Description of Unknown: Exemplary gene or splice site sequence"
uaggugaaag

SEQ ID NO: 5488 - RNA, 10 nt, Unknown
  source: /note="Description of Unknown: Exemplary gene or splice site sequence"
acuguaauuc

SEQ ID NO: 5489 - RNA, 10 nt, Unknown
  source: /note="Description of Unknown: Exemplary gene or splice site sequence"
gcaguacagg

SEQ ID NO: 5490 - RNA, 10 nt, Unknown
  source: /note="Description of Unknown: Exemplary gene or splice site sequence"
ucggugaguc

SEQ ID NO: 5491 - RNA, 10 nt, Unknown
  source: /note="Description of Unknown: Exemplary gene or splice site sequence"
uauguaggga

SEQ ID NO: 5492 - RNA, 10 nt, Unknown
  source: /note="Description of Unknown: Exemplary gene or splice site sequence"
augguauguc

SEQ ID NO: 5493 - RNA, 10 nt, Unknown
  source: /note="Description of Unknown: Exemplary gene or splice site sequence"
guggugugug

SEQ ID NO: 5494 - RNA, 10 nt, Unknown
  source: /note="Description of Unknown: Exemplary gene or splice site sequence"
cuggugaccu

SEQ ID NO: 5495 - RNA, 10 nt, Unknown
  source: /note="Description of Unknown: Exemplary gene or splice site sequence"
aaugugaaua

SEQ ID NO: 5496 - RNA, 10 nt, Unknown
  source: /note="Description of Unknown: Exemplary gene or splice site sequence"
uaggucucac

SEQ ID NO: 5497 - RNA, 10 nt, Unknown
  source: /note="Description of Unknown: Exemplary gene or splice site sequence"
gagguuauug

SEQ ID NO: 5498 - RNA, 10 nt, Unknown
  source: /note="Description of Unknown: Exemplary gene or splice site sequence"
ugaguaggcu

SEQ ID NO: 5499 - RNA, 10 nt, Unknown
  source: /note="Description of Unknown: Exemplary gene or splice site sequence"
cgggcacgua

SEQ ID NO: 5500 - RNA, 10 nt, Unknown
  source: /note="Description of Unknown: Exemplary gene or splice site sequence"
gcaguaaaua

SEQ ID NO: 5501 - RNA, 10 nt, Unknown
  source: /note="Description of Unknown: Exemplary gene or splice site sequence"
ccggugagag

SEQ ID NO: 5502 - RNA, 10 nt, Unknown
  source: /note="Description of Unknown: Exemplary gene or splice site sequence"
uaaguugguc

SEQ ID NO: 5503 - RNA, 10 nt, Unknown
  source: /note="Description of Unknown: Exemplary gene or splice site sequence"
ccggugagcc

SEQ ID NO: 5504 - RNA, 10 nt, Unknown
  source: /note="Description of Unknown: Exemplary gene or splice site sequence"
aagguuguca

SEQ ID NO: 5505 - RNA, 10 nt, Unknown
  source: /note="Description of Unknown: Exemplary gene or splice site sequence"
cugguauuau

SEQ ID NO: 5506 - RNA, 10 nt, Unknown
  source: /note="Description of Unknown: Exemplary gene or splice site sequence"
gggguauggg

SEQ ID NO: 5507 - RNA, 10 nt, Unknown
  source: /note="Description of Unknown: Exemplary gene or splice site sequence"
aaagucagua

SEQ ID NO: 5508 - RNA, 10 nt, Unknown
  source: /note="Description of Unknown: Exemplary gene or splice site sequence"
uuuguaugua

SEQ ID NO: 5509 - RNA, 10 nt, Unknown
  source: /note="Description of Unknown: Exemplary gene or splice site sequence"
uaaguacugc

SEQ ID NO: 5510 - RNA, 10 nt, Unknown
  source: /note="Description of Unknown: Exemplary gene or splice site sequence"
cagguaccaa

SEQ ID NO: 5511 - RNA, 10 nt, Unknown
  source: /note="Description of Unknown: Exemplary gene or splice site sequence"
gaaguucaga

SEQ ID NO: 5512 - RNA, 10 nt, Unknown
  source: /note="Description of Unknown: Exemplary gene or splice site sequence"
auggugcggu

SEQ ID NO: 5513 - RNA, 10 nt, Unknown
  source: /note="Description of Unknown: Exemplary gene or splice site sequence"
guggugaggu

SEQ ID NO: 5514 - RNA, 10 nt, Unknown
  source: /note="Description of Unknown: Exemplary gene or splice site sequence"
ugaguaagcc

SEQ ID NO: 5515 - RNA, 10 nt, Unknown
  source: /note="Description of Unknown: Exemplary gene or splice site sequence"
uauguaaggg

SEQ ID NO: 5516 - RNA, 10 nt, Unknown
  source: /note="Description of Unknown: Exemplary gene or splice site sequence"
gugguggaaa

SEQ ID NO: 5517 - RNA, 10 nt, Unknown
  source: /note="Description of Unknown: Exemplary gene or splice site sequence"
gaggugauug

SEQ ID NO: 5518 - RNA, 10 nt, Unknown
  source: /note="Description of Unknown: Exemplary gene or splice site sequence"
ggaguuugua

SEQ ID NO: 5519 - RNA, 10 nt, Unknown
  source: /note="Description of Unknown: Exemplary gene or splice site sequence"
aaggucacga

SEQ ID NO: 5520 - RNA, 10 nt, Unknown
  source: /note="Description of Unknown: Exemplary gene or splice site sequence"
gugguagagg

SEQ ID NO: 5521 - RNA, 10 nt, Unknown
  source: /note="Description of Unknown: Exemplary gene or splice site sequence"
uaaguauauc

SEQ ID NO: 5522 - RNA, 10 nt, Unknown
  source: /note="Description of Unknown: Exemplary gene or splice site sequence"
aaggugucca

SEQ ID NO: 5523 - RNA, 10 nt, Unknown
  source: /note="Description of Unknown: Exemplary gene or splice site sequence"
uaugugguau

SEQ ID NO: 5524 - RNA, 10 nt, Unknown
  source: /note="Description of Unknown: Exemplary gene or splice site sequence"
gagguacaau

SEQ ID NO: 5525 - RNA, 10 nt, Unknown
  source: /note="Description of Unknown: Exemplary gene or splice site sequence"
aagguggggg

SEQ ID NO: 5526 - RNA, 10 nt, Unknown
  source: /note="Description of Unknown: Exemplary gene or splice site sequence"
ggaguaggug

SEQ ID NO: 5527 - RNA, 10 nt, Unknown
  source: /note="Description of Unknown: Exemplary gene or splice site sequence"
uaggugacuu
